United States Patent 11,464,842 (COMPOSITIONS AND METHOD FOR OPTIMIZED PEPTIDE VACCINES USING RESIDUE OPTIMIZATION) - sequence listing, part 38

SEQ ID NO: 326871 - protein, 16 aa, Artificial Sequence
  Description of Artificial Sequence: Synthetic peptide
  Seed: FTITDQVPFSVSVSQL (PMEL_HUMAN)
  Core: TDQVPFSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FTIXDQXPXSVXVSQL

SEQ ID NO: 326872 - protein, 16 aa, Artificial Sequence
  Description of Artificial Sequence: Synthetic peptide
  Seed: FTITDQVPFSVSVSQL (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQL

SEQ ID NO: 326873 - protein, 16 aa, Artificial Sequence
  Description of Artificial Sequence: Synthetic peptide
  Seed: FTITDQVPFSVSVSQL (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQX

SEQ ID NO: 326874 - protein, 17 aa, Artificial Sequence
  Description of Artificial Sequence: Synthetic peptide
  Seed: FTITDQVPFSVSVSQLR (PMEL_HUMAN)
  Core: ITDQVPFSV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FTXTDXVXFSXSVSQLR

SEQ ID NO: 326875 - protein, 17 aa, Artificial Sequence
  Description of Artificial Sequence: Synthetic peptide
  Seed: FTITDQVPFSVSVSQLR (PMEL_HUMAN)
  Core: TDQVPFSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
FTIXDQXPXSVXVSQLR

SEQ ID NO: 326876 - protein, 17 aa, Artificial Sequence
  Description of Artificial Sequence: Synthetic peptide
  Seed: FTITDQVPFSVSVSQLR (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLR

SEQ ID NO: 326877 - protein, 17 aa, Artificial Sequence
  Description of Artificial Sequence: Synthetic peptide
  Seed: FTITDQVPFSVSVSQLR (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXR

SEQ ID NO: 326878 - protein, 17 aa, Artificial Sequence
  Description of Artificial Sequence: Synthetic peptide
  Seed: FTITDQVPFSVSVSQLR (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLX

SEQ ID NO: 326879 - protein, 18 aa, Artificial Sequence
  Description of Artificial Sequence: Synthetic peptide
  Seed: FTITDQVPFSVSVSQLRA (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLRA

SEQ ID NO: 326880 - protein, 18 aa, Artificial Sequence
  Description of Artificial Sequence: Synthetic peptide
  Seed: FTITDQVPFSVSVSQLRA (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXA

SEQ ID NO: 326881 - protein, 19 aa, Artificial Sequence
  Description of Artificial Sequence: Synthetic peptide
  Seed: FTITDQVPFSVSVSQLRAL (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLRAL

SEQ ID NO: 326882 - protein, 19 aa, Artificial Sequence
  Description of Artificial Sequence: Synthetic peptide
  Seed: FTITDQVPFSVSVSQLRAL (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRAL

SEQ ID NO: 326883 - protein, 19 aa, Artificial Sequence
  Description of Artificial Sequence: Synthetic peptide
  Seed: FTITDQVPFSVSVSQLRAL (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXAL

SEQ ID NO: 326884 - protein, 20 aa, Artificial Sequence
  Description of Artificial Sequence: Synthetic peptide
  Seed: FTITDQVPFSVSVSQLRALD (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLRALD

SEQ ID NO: 326885 - protein, 20 aa, Artificial Sequence
  Description of Artificial Sequence: Synthetic peptide
  Seed: FTITDQVPFSVSVSQLRALD (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRALD

SEQ ID NO: 326886 - protein, 20 aa, Artificial Sequence
  Description of Artificial Sequence: Synthetic peptide
  Seed: FTITDQVPFSVSVSQLRALD (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXALD

SEQ ID NO: 326887 - protein, 20 aa, Artificial Sequence
  Description of Artificial Sequence: Synthetic peptide
  Seed: FTITDQVPFSVSVSQLRALD (PMEL_HUMAN)
  Core: VSVSQLRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSXSVXQXRAXD

SEQ ID NO: 326888 - protein, 21 aa, Artificial Sequence
  Description of Artificial Sequence: Synthetic peptide
  Seed: FTITDQVPFSVSVSQLRALDG (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLRALDG

SEQ ID NO: 326889 - protein, 21 aa, Artificial Sequence
  Description of Artificial Sequence: Synthetic peptide
  Seed: FTITDQVPFSVSVSQLRALDG (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRALDG

SEQ ID NO: 326890 - protein, 21 aa, Artificial Sequence
  Description of Artificial Sequence: Synthetic peptide
  Seed: FTITDQVPFSVSVSQLRALDG (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXALDG

SEQ ID NO: 326891 - protein, 21 aa, Artificial Sequence
  Description of Artificial Sequence: Synthetic peptide
  Seed: FTITDQVPFSVSVSQLRALDG (PMEL_HUMAN)
  Core: VSVSQLRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSXSVXQXRAXDG

SEQ ID NO: 326892 - protein, 22 aa, Artificial Sequence
  Description of Artificial Sequence: Synthetic peptide
  Seed: FTITDQVPFSVSVSQLRALDGG (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLRALDGG

SEQ ID NO: 326893 - protein, 22 aa, Artificial Sequence
  Description of Artificial Sequence: Synthetic peptide
  Seed: FTITDQVPFSVSVSQLRALDGG (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRALDGG

SEQ ID NO: 326894 - protein, 22 aa, Artificial Sequence
  Description of Artificial Sequence: Synthetic peptide
  Seed: FTITDQVPFSVSVSQLRALDGG (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXALDGG

SEQ ID NO: 326895 - protein, 22 aa, Artificial Sequence
  Description of Artificial Sequence: Synthetic peptide
  Seed: FTITDQVPFSVSVSQLRALDGG (PMEL_HUMAN)
  Core: VSVSQLRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSXSVXQXRAXDGG

SEQ ID NO: 326896 - protein, 23 aa, Artificial Sequence
  Description of Artificial Sequence: Synthetic peptide
  Seed: FTITDQVPFSVSVSQLRALDGGN (PMEL_HUMAN)
  Core: QVPFSVSVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FTITDXVPXSXSVXQLRALDGGN

SEQ ID NO: 326897 - protein, 23 aa, Artificial Sequence
  Description of Artificial Sequence: Synthetic peptide
  Seed: FTITDQVPFSVSVSQLRALDGGN (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRALDGGN

SEQ ID NO: 326898 - protein, 23 aa, Artificial Sequence
  Description of Artificial Sequence: Synthetic peptide
  Seed: FTITDQVPFSVSVSQLRALDGGN (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXALDGGN

SEQ ID NO: 326899 - protein, 23 aa, Artificial Sequence
  Description of Artificial Sequence: Synthetic peptide
  Seed: FTITDQVPFSVSVSQLRALDGGN (PMEL_HUMAN)
  Core: VSVSQLRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSXSVXQXRAXDGGN

SEQ ID NO: 326900 - protein, 23 aa, Artificial Sequence
  Description of Artificial Sequence: Synthetic peptide
  Seed: FTITDQVPFSVSVSQLRALDGGN (PMEL_HUMAN)
  Core: VSQLRALDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSVSXSQXRXLDXGN

SEQ ID NO: 326901 - protein, 24 aa, Artificial Sequence
  Description of Artificial Sequence: Synthetic peptide
  Seed: FTITDQVPFSVSVSQLRALDGGNK (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRALDGGNK

SEQ ID NO: 326902 - protein, 24 aa, Artificial Sequence
  Description of Artificial Sequence: Synthetic peptide
  Seed: FTITDQVPFSVSVSQLRALDGGNK (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXALDGGNK

SEQ ID NO: 326903 - protein, 24 aa, Artificial Sequence
  Description of Artificial Sequence: Synthetic peptide
  Seed: FTITDQVPFSVSVSQLRALDGGNK (PMEL_HUMAN)
  Core: VSVSQLRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSXSVXQXRAXDGGNK

SEQ ID NO: 326904 - protein, 24 aa, Artificial Sequence
  Description of Artificial Sequence: Synthetic peptide
  Seed: FTITDQVPFSVSVSQLRALDGGNK (PMEL_HUMAN)
  Core: VSQLRALDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSVSXSQXRXLDXGNK

SEQ ID NO: 326905 - protein, 25 aa, Artificial Sequence
  Description of Artificial Sequence: Synthetic peptide
  Seed: FTITDQVPFSVSVSQLRALDGGNKH (PMEL_HUMAN)
  Core: PFSVSVSQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVXFSXSXSQXRALDGGNKH

SEQ ID NO: 326906 - protein, 25 aa, Artificial Sequence
  Description of Artificial Sequence: Synthetic peptide
  Seed: FTITDQVPFSVSVSQLRALDGGNKH (PMEL_HUMAN)
  Core: FSVSVSQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPXSVXVXQLXALDGGNKH

SEQ ID NO: 326907 - protein, 25 aa, Artificial Sequence
  Description of Artificial Sequence: Synthetic peptide
  Seed: FTITDQVPFSVSVSQLRALDGGNKH (PMEL_HUMAN)
  Core: VSVSQLRAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSXSVXQXRAXDGGNKH

SEQ ID NO: 326908 - protein, 25 aa, Artificial Sequence
  Description of Artificial Sequence: Synthetic peptide
  Seed: FTITDQVPFSVSVSQLRALDGGNKH (PMEL_HUMAN)
  Core: VSQLRALDG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
FTITDQVPFSVSXSQXRXLDXGNKH

SEQ ID NO: 326909 - protein, 14 aa, Artificial Sequence
  Description of Artificial Sequence: Synthetic peptide
  Seed: FVYVWKTWGQYWQV (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQV

SEQ ID NO: 326910 - protein, 15 aa, Artificial Sequence
  Description of Artificial Sequence: Synthetic peptide
  Seed: FVYVWKTWGQYWQVL (PMEL_HUMAN)
  Core: VYVWKTWGQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
FXYVXKXWGXYWQVL

SEQ ID NO: 326911 - protein, 15 aa, Artificial Sequence
  Description of Artificial Sequence: Synthetic peptide
  Seed: FVYVWKTWGQYWQVL (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVL

SEQ ID NO: 326912 - protein, 15 aa, Artificial Sequence
  Description of Artificial Sequence: Synthetic peptide
  Seed: FVYVWKTWGQYWQVL (PMEL_HUMAN)
  Core: WKTWGQYWQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FVYVXKTXGXYWXVL

SEQ ID NO: 326913 - protein, 16 aa, Artificial Sequence
  Description of Artificial Sequence: Synthetic peptide
  Seed: FVYVWKTWGQYWQVLG (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLG

SEQ ID NO: 326914 - protein, 16 aa, Artificial Sequence
  Description of Artificial Sequence: Synthetic peptide
  Seed: FVYVWKTWGQYWQVLG (PMEL_HUMAN)
  Core: WKTWGQYWQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FVYVXKTXGXYWXVLG

SEQ ID NO: 326915 - protein, 17 aa, Artificial Sequence
  Description of Artificial Sequence: Synthetic peptide
  Seed: FVYVWKTWGQYWQVLGG (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGG

SEQ ID NO: 326916 - protein, 17 aa, Artificial Sequence
  Description of Artificial Sequence: Synthetic peptide
  Seed: FVYVWKTWGQYWQVLGG (PMEL_HUMAN)
  Core: WKTWGQYWQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
FVYVXKTXGXYWXVLGG

SEQ ID NO: 326917 - protein, 17 aa, Artificial Sequence
  Description of Artificial Sequence: Synthetic peptide
  Seed: FVYVWKTWGQYWQVLGG (PMEL_HUMAN)
  Core: KTWGQYWQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWXTWXQXWQXLGG

SEQ ID NO: 326918 - protein, 17 aa, Artificial Sequence
  Description of Artificial Sequence: Synthetic peptide
  Seed: FVYVWKTWGQYWQVLGG (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGG

SEQ ID NO: 326919 - protein, 18 aa, Artificial Sequence
  Description of Artificial Sequence: Synthetic peptide
  Seed: FVYVWKTWGQYWQVLGGP (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGP

SEQ ID NO: 326920 - protein, 18 aa, Artificial Sequence
  Description of Artificial Sequence: Synthetic peptide
  Seed: FVYVWKTWGQYWQVLGGP (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGP

SEQ ID NO: 326921 - protein, 18 aa, Artificial Sequence
  Description of Artificial Sequence: Synthetic peptide
  Seed: FVYVWKTWGQYWQVLGGP (PMEL_HUMAN)
  Core: WGQYWQVLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTXGQXWXVLXGP

SEQ ID NO: 326922 - protein, 19 aa, Artificial Sequence
  Description of Artificial Sequence: Synthetic peptide
  Seed: FVYVWKTWGQYWQVLGGPV (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPV

SEQ ID NO: 326923 - protein, 19 aa, Artificial Sequence
  Description of Artificial Sequence: Synthetic peptide
  Seed: FVYVWKTWGQYWQVLGGPV (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPV

SEQ ID NO: 326924 - protein, 19 aa, Artificial Sequence
  Description of Artificial Sequence: Synthetic peptide
  Seed: FVYVWKTWGQYWQVLGGPV (PMEL_HUMAN)
  Core: WGQYWQVLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTXGQXWXVLXGPV

SEQ ID NO: 326925 - protein, 19 aa, Artificial Sequence
  Description of Artificial Sequence: Synthetic peptide
  Seed: FVYVWKTWGQYWQVLGGPV (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPV

SEQ ID NO: 326926 - protein, 19 aa, Artificial Sequence
  Description of Artificial Sequence: Synthetic peptide
  Seed: FVYVWKTWGQYWQVLGGPV (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPX

SEQ ID NO: 326927 - protein, 20 aa, Artificial Sequence
  Description of Artificial Sequence: Synthetic peptide
  Seed: FVYVWKTWGQYWQVLGGPVS (PMEL_HUMAN)
  Core: VYVWKTWGQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
FXYVXKXWGXYWQVLGGPVS

SEQ ID NO: 326928 - protein, 20 aa, Artificial Sequence
  Description of Artificial Sequence: Synthetic peptide
  Seed: FVYVWKTWGQYWQVLGGPVS (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPVS

SEQ ID NO: 326929 - protein, 20 aa, Artificial Sequence
  Description of Artificial Sequence: Synthetic peptide
  Seed: FVYVWKTWGQYWQVLGGPVS (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPVS

SEQ ID NO: 326930 - protein, 20 aa, Artificial Sequence
  Description of Artificial Sequence: Synthetic peptide
  Seed: FVYVWKTWGQYWQVLGGPVS (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPVS

SEQ ID NO: 326931 - protein, 20 aa, Artificial Sequence
  Description of Artificial Sequence: Synthetic peptide
  Seed: FVYVWKTWGQYWQVLGGPVS (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPXS

SEQ ID NO: 326932 - protein, 21 aa, Artificial Sequence
  Description of Artificial Sequence: Synthetic peptide
  Seed: FVYVWKTWGQYWQVLGGPVSG (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPVSG

SEQ ID NO: 326933 - protein, 21 aa, Artificial Sequence
  Description of Artificial Sequence: Synthetic peptide
  Seed: FVYVWKTWGQYWQVLGGPVSG (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPVSG

SEQ ID NO: 326934 - protein, 21 aa, Artificial Sequence
  Description of Artificial Sequence: Synthetic peptide
  Seed: FVYVWKTWGQYWQVLGGPVSG (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPVSG

SEQ ID NO: 326935 - protein, 21 aa, Artificial Sequence
  Description of Artificial Sequence: Synthetic peptide
  Seed: FVYVWKTWGQYWQVLGGPVSG (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPXSG

SEQ ID NO: 326936 - protein, 21 aa, Artificial Sequence
  Description of Artificial Sequence: Synthetic peptide
  Seed: FVYVWKTWGQYWQVLGGPVSG (PMEL_HUMAN)
  Core: WQVLGGPVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYXQVXGXPVXG

SEQ ID NO: 326937 - protein, 22 aa, Artificial Sequence
  Description of Artificial Sequence: Synthetic peptide
  Seed: FVYVWKTWGQYWQVLGGPVSGL (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPVSGL

SEQ ID NO: 326938 - protein, 22 aa, Artificial Sequence
  Description of Artificial Sequence: Synthetic peptide
  Seed: FVYVWKTWGQYWQVLGGPVSGL (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPVSGL

SEQ ID NO: 326939 - protein, 22 aa, Artificial Sequence
  Description of Artificial Sequence: Synthetic peptide
  Seed: FVYVWKTWGQYWQVLGGPVSGL (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPVSGL

SEQ ID NO: 326940 - protein, 22 aa, Artificial Sequence
  Description of Artificial Sequence: Synthetic peptide
  Seed: FVYVWKTWGQYWQVLGGPVSGL (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPXSGL

SEQ ID NO: 326941 - protein, 22 aa, Artificial Sequence
  Description of Artificial Sequence: Synthetic peptide
  Seed: FVYVWKTWGQYWQVLGGPVSGL (PMEL_HUMAN)
  Core: WQVLGGPVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYXQVXGXPVXGL

SEQ ID NO: 326942 - protein, 23 aa, Artificial Sequence
  Description of Artificial Sequence: Synthetic peptide
  Seed: FVYVWKTWGQYWQVLGGPVSGLS (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPVSGLS

SEQ ID NO: 326943 - protein, 23 aa, Artificial Sequence
  Description of Artificial Sequence: Synthetic peptide
  Seed: FVYVWKTWGQYWQVLGGPVSGLS (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPVSGLS

SEQ ID NO: 326944 - protein, 23 aa, Artificial Sequence
  Description of Artificial Sequence: Synthetic peptide
  Seed: FVYVWKTWGQYWQVLGGPVSGLS (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPVSGLS

SEQ ID NO: 326945 - protein, 23 aa, Artificial Sequence
  Description of Artificial Sequence: Synthetic peptide
  Seed: FVYVWKTWGQYWQVLGGPVSGLS (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPXSGLS

SEQ ID NO: 326946 - protein, 23 aa, Artificial Sequence
  Description of Artificial Sequence: Synthetic peptide
  Seed: FVYVWKTWGQYWQVLGGPVSGLS (PMEL_HUMAN)
  Core: WQVLGGPVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYXQVXGXPVXGLS

SEQ ID NO: 326947 - protein, 23 aa, Artificial Sequence
  Description of Artificial Sequence: Synthetic peptide
  Seed: FVYVWKTWGQYWQVLGGPVSGLS (PMEL_HUMAN)
  Core: VLGGPVSGL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYWQXLGXPXSGXS

SEQ ID NO: 326948 - protein, 24 aa, Artificial Sequence
  Description of Artificial Sequence: Synthetic peptide
  Seed: FVYVWKTWGQYWQVLGGPVSGLSI (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPVSGLSI

SEQ ID NO: 326949 - protein, 24 aa, Artificial Sequence
  Description of Artificial Sequence: Synthetic peptide
  Seed: FVYVWKTWGQYWQVLGGPVSGLSI (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPVSGLSI

SEQ ID NO: 326950 - protein, 24 aa, Artificial Sequence
  Description of Artificial Sequence: Synthetic peptide
  Seed: FVYVWKTWGQYWQVLGGPVSGLSI (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPVSGLSI

SEQ ID NO: 326951 - protein, 24 aa, Artificial Sequence
  Description of Artificial Sequence: Synthetic peptide
  Seed: FVYVWKTWGQYWQVLGGPVSGLSI (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPXSGLSI

SEQ ID NO: 326952 - protein, 24 aa, Artificial Sequence
  Description of Artificial Sequence: Synthetic peptide
  Seed: FVYVWKTWGQYWQVLGGPVSGLSI (PMEL_HUMAN)
  Core: WQVLGGPVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYXQVXGXPVXGLSI

SEQ ID NO: 326953 - protein, 24 aa, Artificial Sequence
  Description of Artificial Sequence: Synthetic peptide
  Seed: FVYVWKTWGQYWQVLGGPVSGLSI (PMEL_HUMAN)
  Core: VLGGPVSGL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYWQXLGXPXSGXSI

SEQ ID NO: 326954 - protein, 25 aa, Artificial Sequence
  Description of Artificial Sequence: Synthetic peptide
  Seed: FVYVWKTWGQYWQVLGGPVSGLSIG (PMEL_HUMAN)
  Core: YVWKTWGQY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
FVXVWXTXGQXWQVLGGPVSGLSIG

SEQ ID NO: 326955 - protein, 25 aa, Artificial Sequence
  Description of Artificial Sequence: Synthetic peptide
  Seed: FVYVWKTWGQYWQVLGGPVSGLSIG (PMEL_HUMAN)
  Core: TWGQYWQVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKXWGXYXQVXGGPVSGLSIG

SEQ ID NO: 326956 - protein, 25 aa, Artificial Sequence
  Description of Artificial Sequence: Synthetic peptide
  Seed: FVYVWKTWGQYWQVLGGPVSGLSIG (PMEL_HUMAN)
  Core: GQYWQVLGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWXQYXQXLGXPVSGLSIG

SEQ ID NO: 326957 - protein, 25 aa, Artificial Sequence
  Description of Artificial Sequence: Synthetic peptide
  Seed: FVYVWKTWGQYWQVLGGPVSGLSIG (PMEL_HUMAN)
  Core: YWQVLGGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQXWQXLXGPXSGLSIG

SEQ ID NO: 326958 - protein, 25 aa, Artificial Sequence
  Description of Artificial Sequence: Synthetic peptide
  Seed: FVYVWKTWGQYWQVLGGPVSGLSIG (PMEL_HUMAN)
  Core: WQVLGGPVS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYXQVXGXPVXGLSIG

SEQ ID NO: 326959 - protein, 25 aa, Artificial Sequence
  Description of Artificial Sequence: Synthetic peptide
  Seed: FVYVWKTWGQYWQVLGGPVSGLSIG (PMEL_HUMAN)
  Core: VLGGPVSGL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
FVYVWKTWGQYWQXLGXPXSGXSIG

SEQ ID NO: 326960 - protein, 13 aa, Artificial Sequence
  Description of Artificial Sequence: Synthetic peptide
  Seed: GALLAVGATKVPR (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPR

SEQ ID NO: 326961 - protein, 14 aa, Artificial Sequence
  Description of Artificial Sequence: Synthetic peptide
  Seed: GALLAVGATKVPRN (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRN

SEQ ID NO: 326962 - protein, 14 aa, Artificial Sequence
  Description of Artificial Sequence: Synthetic peptide
  Seed: GALLAVGATKVPRN (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRX

SEQ ID NO: 326963 - protein, 15 aa, Artificial Sequence
  Description of Artificial Sequence: Synthetic peptide
  Seed: GALLAVGATKVPRNQ (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQ

SEQ ID NO: 326964 - protein, 15 aa, Artificial Sequence
  Description of Artificial Sequence: Synthetic peptide
  Seed: GALLAVGATKVPRNQ (PMEL_HUMAN)
  Core: AVGATKVPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GALLXVGXTXVPXNQ

SEQ ID NO: 326965 - protein, 15 aa, Artificial Sequence
  Description of Artificial Sequence: Synthetic peptide
  Seed: GALLAVGATKVPRNQ (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQ

SEQ ID NO: 326966 - protein, 16 aa, Artificial Sequence
  Description of Artificial Sequence: Synthetic peptide
  Seed: GALLAVGATKVPRNQD (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQD

SEQ ID NO: 326967 - protein, 16 aa, Artificial Sequence
  Description of Artificial Sequence: Synthetic peptide
  Seed: GALLAVGATKVPRNQD (PMEL_HUMAN)
  Core: AVGATKVPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GALLXVGXTXVPXNQD

SEQ ID NO: 326968 - protein, 16 aa, Artificial Sequence
  Description of Artificial Sequence: Synthetic peptide
  Seed: GALLAVGATKVPRNQD (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQD

SEQ ID NO: 326969 - protein, 17 aa, Artificial Sequence
  Description of Artificial Sequence: Synthetic peptide
  Seed: GALLAVGATKVPRNQDW (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDW

SEQ ID NO: 326970 - protein, 17 aa, Artificial Sequence
  Description of Artificial Sequence: Synthetic peptide
  Seed: GALLAVGATKVPRNQDW (PMEL_HUMAN)
  Core: AVGATKVPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GALLXVGXTXVPXNQDW

SEQ ID NO: 326971 - protein, 17 aa, Artificial Sequence
  Description of Artificial Sequence: Synthetic peptide
  Seed: GALLAVGATKVPRNQDW (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDW

SEQ ID NO: 326972 - protein, 18 aa, Artificial Sequence
  Description of Artificial Sequence: Synthetic peptide
  Seed: GALLAVGATKVPRNQDWL (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWL

SEQ ID NO: 326973 - protein, 18 aa, Artificial Sequence
  Description of Artificial Sequence: Synthetic peptide
  Seed: GALLAVGATKVPRNQDWL (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWL

SEQ ID NO: 326974 - protein, 19 aa, Artificial Sequence
  Description of Artificial Sequence: Synthetic peptide
  Seed: GALLAVGATKVPRNQDWLG (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLG

SEQ ID NO: 326975 - protein, 19 aa, Artificial Sequence
  Description of Artificial Sequence: Synthetic peptide
  Seed: GALLAVGATKVPRNQDWLG (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLG

SEQ ID NO: 326976 - protein, 20 aa, Artificial Sequence
  Description of Artificial Sequence: Synthetic peptide
  Seed: GALLAVGATKVPRNQDWLGV (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLGV

SEQ ID NO: 326977 - protein, 20 aa, Artificial Sequence
  Description of Artificial Sequence: Synthetic peptide
  Seed: GALLAVGATKVPRNQDWLGV (PMEL_HUMAN)
  Core: AVGATKVPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GALLXVGXTXVPXNQDWLGV

SEQ ID NO: 326978 - protein, 20 aa, Artificial Sequence
  Description of Artificial Sequence: Synthetic peptide
  Seed: GALLAVGATKVPRNQDWLGV (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLGV

SEQ ID NO: 326979 - protein, 21 aa, Artificial Sequence
  Description of Artificial Sequence: Synthetic peptide
  Seed: GALLAVGATKVPRNQDWLGVS (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLGVS

SEQ ID NO: 326980 - protein, 21 aa, Artificial Sequence
  Description of Artificial Sequence: Synthetic peptide
  Seed: GALLAVGATKVPRNQDWLGVS (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLGVS

SEQ ID NO: 326981 - protein, 22 aa, Artificial Sequence
  Description of Artificial Sequence: Synthetic peptide
  Seed: GALLAVGATKVPRNQDWLGVSR (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLGVSR

SEQ ID NO: 326982 - protein, 22 aa, Artificial Sequence
  Description of Artificial Sequence: Synthetic peptide
  Seed: GALLAVGATKVPRNQDWLGVSR (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLGVSR

SEQ ID NO: 326983 - protein, 23 aa, Artificial Sequence
  Description of Artificial Sequence: Synthetic peptide
  Seed: GALLAVGATKVPRNQDWLGVSRQ (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLGVSRQ

SEQ ID NO: 326984 - protein, 23 aa, Artificial Sequence
  Description of Artificial Sequence: Synthetic peptide
  Seed: GALLAVGATKVPRNQDWLGVSRQ (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLGVSRQ

SEQ ID NO: 326985 - protein, 24 aa, Artificial Sequence
  Description of Artificial Sequence: Synthetic peptide
  Seed: GALLAVGATKVPRNQDWLGVSRQL (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLGVSRQL

SEQ ID NO: 326986 - protein, 24 aa, Artificial Sequence
  Description of Artificial Sequence: Synthetic peptide
  Seed: GALLAVGATKVPRNQDWLGVSRQL (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLGVSRQL

SEQ ID NO: 326987 - protein, 24 aa, Artificial Sequence
  Description of Artificial Sequence: Synthetic peptide
  Seed: GALLAVGATKVPRNQDWLGVSRQL (PMEL_HUMAN)
  Core: RNQDWLGVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GALLAVGATKVPXNQXWXGVXRQL

SEQ ID NO: 326988 - protein, 25 aa, Artificial Sequence
  Description of Artificial Sequence: Synthetic peptide
  Seed: GALLAVGATKVPRNQDWLGVSRQLR (PMEL_HUMAN)
  Core: LLAVGATKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXLAXGXTKXPRNQDWLGVSRQLR

SEQ ID NO: 326989 - protein, 25 aa, Artificial Sequence
  Description of Artificial Sequence: Synthetic peptide
  Seed: GALLAVGATKVPRNQDWLGVSRQLR (PMEL_HUMAN)
  Core: AVGATKVPR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GALLXVGXTXVPXNQDWLGVSRQLR

SEQ ID NO: 326990 - protein, 25 aa, Artificial Sequence
  Description of Artificial Sequence: Synthetic peptide
  Seed: GALLAVGATKVPRNQDWLGVSRQLR (PMEL_HUMAN)
  Core: VGATKVPRN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GALLAXGAXKXPRXQDWLGVSRQLR

SEQ ID NO: 326991 - protein, 25 aa, Artificial Sequence
  Description of Artificial Sequence: Synthetic peptide
  Seed: GALLAVGATKVPRNQDWLGVSRQLR (PMEL_HUMAN)
  Core: ATKVPRNQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GALLAVGXTKXPXNQXWLGVSRQLR

SEQ ID NO: 326992 - protein, 25 aa, Artificial Sequence
  Description of Artificial Sequence: Synthetic peptide
  Seed: GALLAVGATKVPRNQDWLGVSRQLR (PMEL_HUMAN)
  Core: RNQDWLGVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GALLAVGATKVPXNQXWXGVXRQLR

SEQ ID NO: 326993 - protein, 13 aa, Artificial Sequence
  Description of Artificial Sequence: Synthetic peptide
  Seed: GANASFSIALNFP (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFP

SEQ ID NO: 326994 - protein, 14 aa, Artificial Sequence
  Description of Artificial Sequence: Synthetic peptide
  Seed: GANASFSIALNFPG (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPG

SEQ ID NO: 326995 - protein, 14 aa, Artificial Sequence
  Description of Artificial Sequence: Synthetic peptide
  Seed: GANASFSIALNFPG (PMEL_HUMAN)
  Core: ASFSIALNF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GANXSFXIXLNXPG

SEQ ID NO: 326996 - protein, 14 aa, Artificial Sequence
  Description of Artificial Sequence: Synthetic peptide
  Seed: GANASFSIALNFPG (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPX

SEQ ID NO: 326997 - protein, 15 aa, Artificial Sequence
  Description of Artificial Sequence: Synthetic peptide
  Seed: GANASFSIALNFPGS (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPGS

SEQ ID NO: 326998 - protein, 15 aa, Artificial Sequence
  Description of Artificial Sequence: Synthetic peptide
  Seed: GANASFSIALNFPGS (PMEL_HUMAN)
  Core: ASFSIALNF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GANXSFXIXLNXPGS

SEQ ID NO: 326999 - protein, 15 aa, Artificial Sequence
  Description of Artificial Sequence: Synthetic peptide
  Seed: GANASFSIALNFPGS (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXS

SEQ ID NO: 327000 - protein, 16 aa, Artificial Sequence
  Description of Artificial Sequence: Synthetic peptide
  Seed: GANASFSIALNFPGSQ (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPGSQ

SEQ ID NO: 327001 - protein, 16 aa, Artificial Sequence
  Description of Artificial Sequence: Synthetic peptide
  Seed: GANASFSIALNFPGSQ (PMEL_HUMAN)
  Core: ASFSIALNF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GANXSFXIXLNXPGSQ

SEQ ID NO: 327002 - protein, 16 aa, Artificial Sequence
  Description of Artificial Sequence: Synthetic peptide
  Seed: GANASFSIALNFPGSQ (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQ

SEQ ID NO: 327003 - protein, 17 aa, Artificial Sequence
  Description of Artificial Sequence: Synthetic peptide
  Seed: GANASFSIALNFPGSQK (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPGSQK

SEQ ID NO: 327004 - protein, 17 aa, Artificial Sequence
  Description of Artificial Sequence: Synthetic peptide
  Seed: GANASFSIALNFPGSQK (PMEL_HUMAN)
  Core: ASFSIALNF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GANXSFXIXLNXPGSQK

SEQ ID NO: 327005 - protein, 17 aa, Artificial Sequence
  Description of Artificial Sequence: Synthetic peptide
  Seed: GANASFSIALNFPGSQK (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQK

SEQ ID NO: 327006 - protein, 18 aa, Artificial Sequence
  Description of Artificial Sequence: Synthetic peptide
  Seed: GANASFSIALNFPGSQKV (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPGSQKV

SEQ ID NO: 327007 - protein, 18 aa, Artificial Sequence
  Description of Artificial Sequence: Synthetic peptide
  Seed: GANASFSIALNFPGSQKV (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKV

SEQ ID NO: 327008 - protein, 19 aa, Artificial Sequence
  Description of Artificial Sequence: Synthetic peptide
  Seed: GANASFSIALNFPGSQKVL (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPGSQKVL

SEQ ID NO: 327009 - protein, 19 aa, Artificial Sequence
  Description of Artificial Sequence: Synthetic peptide
  Seed: GANASFSIALNFPGSQKVL (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVL

SEQ ID NO: 327010 - protein, 20 aa, Artificial Sequence
  Description of Artificial Sequence: Synthetic peptide
  Seed: GANASFSIALNFPGSQKVLP (PMEL_HUMAN)
  Core: NASFSIALN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GAXASXSXALXFPGSQKVLP

SEQ ID NO: 327011 - protein, 20 aa, Artificial Sequence
  Description of Artificial Sequence: Synthetic peptide
  Seed: GANASFSIALNFPGSQKVLP (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVLP

SEQ ID NO: 327012 - protein, 20 aa, Artificial Sequence
  Description of Artificial Sequence: Synthetic peptide
  Seed: GANASFSIALNFPGSQKVLP (PMEL_HUMAN)
  Core: LNFPGSQKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIAXNFXGXQKXLP

SEQ ID NO: 327013 - protein, 21 aa, Artificial Sequence
  Description of Artificial Sequence: Synthetic peptide
  Seed: GANASFSIALNFPGSQKVLPD (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVLPD

SEQ ID NO: 327014 - protein, 21 aa, Artificial Sequence
  Description of Artificial Sequence: Synthetic peptide
  Seed: GANASFSIALNFPGSQKVLPD (PMEL_HUMAN)
  Core: LNFPGSQKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIAXNFXGXQKXLPD

SEQ ID NO: 327015 - protein, 22 aa, Artificial Sequence
  Description of Artificial Sequence: Synthetic peptide
  Seed: GANASFSIALNFPGSQKVLPDG (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVLPDG

SEQ ID NO: 327016 - protein, 22 aa, Artificial Sequence
  Description of Artificial Sequence: Synthetic peptide
  Seed: GANASFSIALNFPGSQKVLPDG (PMEL_HUMAN)
  Core: LNFPGSQKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIAXNFXGXQKXLPDG

SEQ ID NO: 327017 - protein, 23 aa, Artificial Sequence
  Description of Artificial Sequence: Synthetic peptide
  Seed: GANASFSIALNFPGSQKVLPDGQ (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVLPDGQ

SEQ ID NO: 327018 - protein, 23 aa, Artificial Sequence
  Description of Artificial Sequence: Synthetic peptide
  Seed: GANASFSIALNFPGSQKVLPDGQ (PMEL_HUMAN)
  Core: LNFPGSQKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIAXNFXGXQKXLPDGQ

SEQ ID NO: 327019 - protein, 23 aa, Artificial Sequence
  Description of Artificial Sequence: Synthetic peptide
  Seed: GANASFSIALNFPGSQKVLPDGQ (PMEL_HUMAN)
  Core: PGSQKVLPD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIALNFXGSXKXLPXGQ

SEQ ID NO: 327020 - protein, 24 aa, Artificial Sequence
  Description of Artificial Sequence: Synthetic peptide
  Seed: GANASFSIALNFPGSQKVLPDGQV (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVLPDGQV

SEQ ID NO: 327021 - protein, 24 aa, Artificial Sequence
  Description of Artificial Sequence: Synthetic peptide
  Seed: GANASFSIALNFPGSQKVLPDGQV (PMEL_HUMAN)
  Core: LNFPGSQKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIAXNFXGXQKXLPDGQV

SEQ ID NO: 327022 - protein, 24 aa, Artificial Sequence
  Description of Artificial Sequence: Synthetic peptide
  Seed: GANASFSIALNFPGSQKVLPDGQV (PMEL_HUMAN)
  Core: PGSQKVLPD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIALNFXGSXKXLPXGQV

SEQ ID NO: 327023 - protein, 25 aa, Artificial Sequence
  Description of Artificial Sequence: Synthetic peptide
  Seed: GANASFSIALNFPGSQKVLPDGQVI (PMEL_HUMAN)
  Core: FSIALNFPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GANASXSIXLXFPXSQKVLPDGQVI

SEQ ID NO: 327024 - protein, 25 aa, Artificial Sequence
  Description of Artificial Sequence: Synthetic peptide
  Seed: GANASFSIALNFPGSQKVLPDGQVI (PMEL_HUMAN)
  Core: LNFPGSQKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIAXNFXGXQKXLPDGQVI

SEQ ID NO: 327025 - protein, 25 aa, Artificial Sequence
  Description of Artificial Sequence: Synthetic peptide
  Seed: GANASFSIALNFPGSQKVLPDGQVI (PMEL_HUMAN)
  Core: PGSQKVLPD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GANASFSIALNFXGSXKXLPXGQVI

SEQ ID NO: 327026 - protein, 20 aa, Artificial Sequence
  Description of Artificial Sequence: Synthetic peptide
  Seed: GATKVPRNQDWLGVSRQLRT (PMEL_HUMAN)
  Core: RNQDWLGVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPXNQXWXGVXRQLRT

SEQ ID NO: 327027 - protein, 20 aa, Artificial Sequence
  Description of Artificial Sequence: Synthetic peptide
  Seed: GATKVPRNQDWLGVSRQLRT (PMEL_HUMAN)
  Core: WLGVSRQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPRNQDXLGXSXQLXT

SEQ ID NO: 327028 - protein, 21 aa, Artificial Sequence
  Description of Artificial Sequence: Synthetic peptide
  Seed: GATKVPRNQDWLGVSRQLRTK (PMEL_HUMAN)
  Core: WLGVSRQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPRNQDXLGXSXQLXTK

SEQ ID NO: 327029 - protein, 22 aa, Artificial Sequence
  Description of Artificial Sequence: Synthetic peptide
  Seed: GATKVPRNQDWLGVSRQLRTKA (PMEL_HUMAN)
  Core: WLGVSRQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPRNQDXLGXSXQLXTKA

SEQ ID NO: 327030 - protein, 23 aa, Artificial Sequence
  Description of Artificial Sequence: Synthetic peptide
  Seed: GATKVPRNQDWLGVSRQLRTKAW (PMEL_HUMAN)
  Core: RNQDWLGVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPXNQXWXGVXRQLRTKAW

SEQ ID NO: 327031 - protein, 23 aa, Artificial Sequence
  Description of Artificial Sequence: Synthetic peptide
  Seed: GATKVPRNQDWLGVSRQLRTKAW (PMEL_HUMAN)
  Core: WLGVSRQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPRNQDXLGXSXQLXTKAW

SEQ ID NO: 327032 - protein, 24 aa, Artificial Sequence
  Description of Artificial Sequence: Synthetic peptide
  Seed: GATKVPRNQDWLGVSRQLRTKAWN (PMEL_HUMAN)
  Core: RNQDWLGVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPXNQXWXGVXRQLRTKAWN

SEQ ID NO: 327033 - protein, 24 aa, Artificial Sequence
  Description of Artificial Sequence: Synthetic peptide
  Seed: GATKVPRNQDWLGVSRQLRTKAWN (PMEL_HUMAN)
  Core: WLGVSRQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPRNQDXLGXSXQLXTKAWN

SEQ ID NO: 327034 - protein, 25 aa, Artificial Sequence
  Description of Artificial Sequence: Synthetic peptide
  Seed: GATKVPRNQDWLGVSRQLRTKAWNR (PMEL_HUMAN)
  Core: RNQDWLGVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPXNQXWXGVXRQLRTKAWNR

SEQ ID NO: 327035 - protein, 25 aa, Artificial Sequence
  Description of Artificial Sequence: Synthetic peptide
  Seed: GATKVPRNQDWLGVSRQLRTKAWNR (PMEL_HUMAN)
  Core: WLGVSRQLR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GATKVPRNQDXLGXSXQLXTKAWNR

SEQ ID NO: 327036 - protein, 20 aa, Artificial Sequence
  Description of Artificial Sequence: Synthetic peptide
  Seed: GCQPPAQRLCQPVLPSPACQ (PMEL_HUMAN)
  Core: RLCQPVLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAQXLCXPXLPXPACQ

SEQ ID NO: 327037 - protein, 22 aa, Artificial Sequence
  Description of Artificial Sequence: Synthetic peptide
  Seed: GCQPPAQRLCQPVLPSPACQLV (PMEL_HUMAN)
  Core: QRLCQPVLP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAXRLXQXVLXSPACQLV

SEQ ID NO: 327038 - protein, 23 aa, Artificial Sequence
  Description of Artificial Sequence: Synthetic peptide
  Seed: GCQPPAQRLCQPVLPSPACQLVL (PMEL_HUMAN)
  Core: QRLCQPVLP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAXRLXQXVLXSPACQLVL

SEQ ID NO: 327039 - protein, 23 aa, Artificial Sequence
  Description of Artificial Sequence: Synthetic peptide
  Seed: GCQPPAQRLCQPVLPSPACQLVL (PMEL_HUMAN)
  Core: VLPSPACQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAQRLCQPXLPXPXCQXVL

SEQ ID NO: 327040 - protein, 24 aa, Artificial Sequence
  Description of Artificial Sequence: Synthetic peptide
  Seed: GCQPPAQRLCQPVLPSPACQLVLH (PMEL_HUMAN)
  Core: QRLCQPVLP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAXRLXQXVLXSPACQLVLH

SEQ ID NO: 327041 - protein, 24 aa, Artificial Sequence
  Description of Artificial Sequence: Synthetic peptide
  Seed: GCQPPAQRLCQPVLPSPACQLVLH (PMEL_HUMAN)
  Core: RLCQPVLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAQXLCXPXLPXPACQLVLH

SEQ ID NO: 327042 - protein, 24 aa, Artificial Sequence
  Description of Artificial Sequence: Synthetic peptide
  Seed: GCQPPAQRLCQPVLPSPACQLVLH (PMEL_HUMAN)
  Core: VLPSPACQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAQRLCQPXLPXPXCQXVLH

SEQ ID NO: 327043 - protein, 25 aa, Artificial Sequence
  Description of Artificial Sequence: Synthetic peptide
  Seed: GCQPPAQRLCQPVLPSPACQLVLHQ (PMEL_HUMAN)
  Core: QRLCQPVLP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAXRLXQXVLXSPACQLVLHQ

SEQ ID NO: 327044 - protein, 25 aa, Artificial Sequence
  Description of Artificial Sequence: Synthetic peptide
  Seed: GCQPPAQRLCQPVLPSPACQLVLHQ (PMEL_HUMAN)
  Core: RLCQPVLPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAQXLCXPXLPXPACQLVLHQ

SEQ ID NO: 327045 - protein, 25 aa, Artificial Sequence
  Description of Artificial Sequence: Synthetic peptide
  Seed: GCQPPAQRLCQPVLPSPACQLVLHQ (PMEL_HUMAN)
  Core: VLPSPACQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GCQPPAQRLCQPXLPXPXCQXVLHQ

SEQ ID NO: 327046 - protein, 15 aa, Artificial Sequence
  Description of Artificial Sequence: Synthetic peptide
  Seed: GDAFELTVSCQGGLP (PMEL_HUMAN)
  Core: FELTVSCQG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GDAXELXVXCQXGLP

SEQ ID NO: 327047 - protein, 19 aa, Artificial Sequence
  Description of Artificial Sequence: Synthetic peptide
  Seed: GDAFELTVSCQGGLPKEAC (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXC

SEQ ID NO: 327048 - protein, 20 aa, Artificial Sequence
  Description of Artificial Sequence: Synthetic peptide
  Seed: GDAFELTVSCQGGLPKEACM (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXCM

SEQ ID NO: 327049 - protein, 21 aa, Artificial Sequence
  Description of Artificial Sequence: Synthetic peptide
  Seed: GDAFELTVSCQGGLPKEACME (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXCME

SEQ ID NO: 327050 - protein, 22 aa, Artificial Sequence
  Description of Artificial Sequence: Synthetic peptide
  Seed: GDAFELTVSCQGGLPKEACMEI (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXCMEI

SEQ ID NO: 327051 - protein, 23 aa, Artificial Sequence
  Description of Artificial Sequence: Synthetic peptide
  Seed: GDAFELTVSCQGGLPKEACMEIS (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXCMEIS

SEQ ID NO: 327052 - protein, 24 aa, Artificial Sequence
  Description of Artificial Sequence: Synthetic peptide
  Seed: GDAFELTVSCQGGLPKEACMEISS (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXCMEISS

SEQ ID NO: 327053 - protein, 25 aa, Artificial Sequence
  Description of Artificial Sequence: Synthetic peptide
  Seed: GDAFELTVSCQGGLPKEACMEISSP (PMEL_HUMAN)
  Core: CQGGLPKEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDAFELTVSXQGXLXKEXCMEISSP

SEQ ID NO: 327054 - protein, 13 aa, Artificial Sequence
  Description of Artificial Sequence: Synthetic peptide
  Seed: GDSSGTLISRALV (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLV

SEQ ID NO: 327055 - protein, 14 aa, Artificial Sequence
  Description of Artificial Sequence: Synthetic peptide
  Seed: GDSSGTLISRALVV (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVV

SEQ ID NO: 327056 - protein, 14 aa, Artificial Sequence
  Description of Artificial Sequence: Synthetic peptide
  Seed: GDSSGTLISRALVV (PMEL_HUMAN)
  Core: SGTLISRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GDSXGTXIXRAXVV

SEQ ID NO: 327057 - protein, 14 aa, Artificial Sequence
  Description of Artificial Sequence: Synthetic peptide
  Seed: GDSSGTLISRALVV (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVX

SEQ ID NO: 327058 - protein, 15 aa, Artificial Sequence
  Description of Artificial Sequence: Synthetic peptide
  Seed: GDSSGTLISRALVVT (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVT

SEQ ID NO: 327059 - protein, 15 aa, Artificial Sequence
  Description of Artificial Sequence: Synthetic peptide
  Seed: GDSSGTLISRALVVT (PMEL_HUMAN)
  Core: SGTLISRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GDSXGTXIXRAXVVT

SEQ ID NO: 327060 - protein, 15 aa, Artificial Sequence
  Description of Artificial Sequence: Synthetic peptide
  Seed: GDSSGTLISRALVVT (PMEL_HUMAN)
  Core: GTLISRALV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GDSSXTLXSXALXVT

SEQ ID NO: 327061 - protein, 15 aa, Artificial Sequence
  Description of Artificial Sequence: Synthetic peptide
  Seed: GDSSGTLISRALVVT (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXT

SEQ ID NO: 327062 - protein, 15 aa, Artificial Sequence
  Description of Artificial Sequence: Synthetic peptide
  Seed: GDSSGTLISRALVVT (PMEL_HUMAN)
  Core: LISRALVVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTXISXAXVVX

SEQ ID NO: 327063 - protein, 16 aa, Artificial Sequence
  Description of Artificial Sequence: Synthetic peptide
  Seed: GDSSGTLISRALVVTH (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTH

SEQ ID NO: 327064 - protein, 16 aa, Artificial Sequence
  Description of Artificial Sequence: Synthetic peptide
  Seed: GDSSGTLISRALVVTH (PMEL_HUMAN)
  Core: SGTLISRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GDSXGTXIXRAXVVTH

SEQ ID NO: 327065 - protein, 16 aa, Artificial Sequence
  Description of Artificial Sequence: Synthetic peptide
  Seed: GDSSGTLISRALVVTH (PMEL_HUMAN)
  Core: GTLISRALV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GDSSXTLXSXALXVTH

SEQ ID NO: 327066 - protein, 16 aa, Artificial Sequence
  Description of Artificial Sequence: Synthetic peptide
  Seed: GDSSGTLISRALVVTH (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTH

SEQ ID NO: 327067 - protein, 16 aa, Artificial Sequence
  Description of Artificial Sequence: Synthetic peptide
  Seed: GDSSGTLISRALVVTH (PMEL_HUMAN)
  Core: LISRALVVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTXISXAXVVXH

SEQ ID NO: 327068 - protein, 16 aa, Artificial Sequence
  Description of Artificial Sequence: Synthetic peptide
  Seed: GDSSGTLISRALVVTH (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTX

SEQ ID NO: 327069 - protein, 17 aa, Artificial Sequence
  Description of Artificial Sequence: Synthetic peptide
  Seed: GDSSGTLISRALVVTHT (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHT

SEQ ID NO: 327070 - protein, 17 aa, Artificial Sequence
  Description of Artificial Sequence: Synthetic peptide
  Seed: GDSSGTLISRALVVTHT (PMEL_HUMAN)
  Core: GTLISRALV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GDSSXTLXSXALXVTHT

SEQ ID NO: 327071 - protein, 17 aa, Artificial Sequence
  Description of Artificial Sequence: Synthetic peptide
  Seed: GDSSGTLISRALVVTHT (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTHT

SEQ ID NO: 327072 - protein, 17 aa, Artificial Sequence
  Description of Artificial Sequence: Synthetic peptide
  Seed: GDSSGTLISRALVVTHT (PMEL_HUMAN)
  Core: LISRALVVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTXISXAXVVXHT

SEQ ID NO: 327073 - protein, 17 aa, Artificial Sequence
  Description of Artificial Sequence: Synthetic peptide
  Seed: GDSSGTLISRALVVTHT (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTXT

SEQ ID NO: 327074 - protein, 18 aa, Artificial Sequence
  Description of Artificial Sequence: Synthetic peptide
  Seed: GDSSGTLISRALVVTHTY (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHTY

SEQ ID NO: 327075 - protein, 18 aa, Artificial Sequence
  Description of Artificial Sequence: Synthetic peptide
  Seed: GDSSGTLISRALVVTHTY (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTHTY

SEQ ID NO: 327076 - protein, 18 aa, Artificial Sequence
  Description of Artificial Sequence: Synthetic peptide
  Seed: GDSSGTLISRALVVTHTY (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTXTY

SEQ ID NO: 327077 - protein, 19 aa, Artificial Sequence
  Description of Artificial Sequence: Synthetic peptide
  Seed: GDSSGTLISRALVVTHTYL (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHTYL

SEQ ID NO: 327078 - protein, 19 aa, Artificial Sequence
  Description of Artificial Sequence: Synthetic peptide
  Seed: GDSSGTLISRALVVTHTYL (PMEL_HUMAN)
  Core: GTLISRALV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GDSSXTLXSXALXVTHTYL

SEQ ID NO: 327079 - protein, 19 aa, Artificial Sequence
  Description of Artificial Sequence: Synthetic peptide
  Seed: GDSSGTLISRALVVTHTYL (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTHTYL

SEQ ID NO: 327080 - protein, 19 aa, Artificial Sequence
  Description of Artificial Sequence: Synthetic peptide
  Seed: GDSSGTLISRALVVTHTYL (PMEL_HUMAN)
  Core: LISRALVVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTXISXAXVVXHTYL

SEQ ID NO: 327081 - protein, 19 aa, Artificial Sequence
  Description of Artificial Sequence: Synthetic peptide
  Seed: GDSSGTLISRALVVTHTYL (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTXTYL

SEQ ID NO: 327082 - protein, 19 aa, Artificial Sequence
  Description of Artificial Sequence: Synthetic peptide
  Seed: GDSSGTLISRALVVTHTYL (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYL

SEQ ID NO: 327083 - protein, 20 aa, Artificial Sequence
  Description of Artificial Sequence: Synthetic peptide
  Seed: GDSSGTLISRALVVTHTYLE (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHTYLE

SEQ ID NO: 327084 - protein, 20 aa, Artificial Sequence
  Description of Artificial Sequence: Synthetic peptide
  Seed: GDSSGTLISRALVVTHTYLE (PMEL_HUMAN)
  Core: SGTLISRAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GDSXGTXIXRAXVVTHTYLE

SEQ ID NO: 327085 - protein, 20 aa, Artificial Sequence
  Description of Artificial Sequence: Synthetic peptide
  Seed: GDSSGTLISRALVVTHTYLE (PMEL_HUMAN)
  Core: GTLISRALV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GDSSXTLXSXALXVTHTYLE

SEQ ID NO: 327086 - protein, 20 aa, Artificial Sequence
  Description of Artificial Sequence: Synthetic peptide
  Seed: GDSSGTLISRALVVTHTYLE (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTHTYLE

SEQ ID NO: 327087 - protein, 20 aa, Artificial Sequence
  Description of Artificial Sequence: Synthetic peptide
  Seed: GDSSGTLISRALVVTHTYLE (PMEL_HUMAN)
  Core: LISRALVVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTXISXAXVVXHTYLE

SEQ ID NO: 327088 - protein, 20 aa, Artificial Sequence
  Description of Artificial Sequence: Synthetic peptide
  Seed: GDSSGTLISRALVVTHTYLE (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTXTYLE

SEQ ID NO: 327089 - protein, 20 aa, Artificial Sequence
  Description of Artificial Sequence: Synthetic peptide
  Seed: GDSSGTLISRALVVTHTYLE (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYLE

SEQ ID NO: 327090 - protein, 20 aa, Artificial Sequence
  Description of Artificial Sequence: Synthetic peptide
  Seed: GDSSGTLISRALVVTHTYLE (PMEL_HUMAN)
  Core: RALVVTHTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISXALXVXHTXLE

SEQ ID NO: 327091 - protein, 20 aa, Artificial Sequence
  Description of Artificial Sequence: Synthetic peptide
  Seed: GDSSGTLISRALVVTHTYLE (PMEL_HUMAN)
  Core: LVVTHTYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRAXVVXHXYLX

SEQ ID NO: 327092 - protein, 21 aa, Artificial Sequence
  Description of Artificial Sequence: Synthetic peptide
  Seed: GDSSGTLISRALVVTHTYLEP (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHTYLEP

SEQ ID NO: 327093 - protein, 21 aa, Artificial Sequence
  Description of Artificial Sequence: Synthetic peptide
  Seed: GDSSGTLISRALVVTHTYLEP (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTHTYLEP

SEQ ID NO: 327094 - protein, 21 aa, Artificial Sequence
  Description of Artificial Sequence: Synthetic peptide
  Seed: GDSSGTLISRALVVTHTYLEP (PMEL_HUMAN)
  Core: LISRALVVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTXISXAXVVXHTYLEP

SEQ ID NO: 327095 - protein, 21 aa, Artificial Sequence
  Description of Artificial Sequence: Synthetic peptide
  Seed: GDSSGTLISRALVVTHTYLEP (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTXTYLEP

SEQ ID NO: 327096 - protein, 21 aa, Artificial Sequence
  Description of Artificial Sequence: Synthetic peptide
  Seed: GDSSGTLISRALVVTHTYLEP (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYLEP

SEQ ID NO: 327097 - protein, 21 aa, Artificial Sequence
  Description of Artificial Sequence: Synthetic peptide
  Seed: GDSSGTLISRALVVTHTYLEP (PMEL_HUMAN)
  Core: RALVVTHTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISXALXVXHTXLEP

SEQ ID NO: 327098 - protein, 21 aa, Artificial Sequence
  Description of Artificial Sequence: Synthetic peptide
  Seed: GDSSGTLISRALVVTHTYLEP (PMEL_HUMAN)
  Core: LVVTHTYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRAXVVXHXYLXP

SEQ ID NO: 327099 - protein, 21 aa, Artificial Sequence
  Description of Artificial Sequence: Synthetic peptide
  Seed: GDSSGTLISRALVVTHTYLEP (PMEL_HUMAN)
  Core: VVTHTYLEP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALXVTXTXLEX

SEQ ID NO: 327100 - protein, 22 aa, Artificial Sequence
  Description of Artificial Sequence: Synthetic peptide
  Seed: GDSSGTLISRALVVTHTYLEPG (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHTYLEPG

SEQ ID NO: 327101 - protein, 22 aa, Artificial Sequence
  Description of Artificial Sequence: Synthetic peptide
  Seed: GDSSGTLISRALVVTHTYLEPG (PMEL_HUMAN)
  Core: TLISRALVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGXLIXRXLVXTHTYLEPG

SEQ ID NO: 327102 - protein, 22 aa, Artificial Sequence
  Description of Artificial Sequence: Synthetic peptide
  Seed: GDSSGTLISRALVVTHTYLEPG (PMEL_HUMAN)
  Core: ISRALVVTH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLXSRXLXVTXTYLEPG

SEQ ID NO: 327103 - protein, 22 aa, Artificial Sequence
  Description of Artificial Sequence: Synthetic peptide
  Seed: GDSSGTLISRALVVTHTYLEPG (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYLEPG

SEQ ID NO: 327104 - protein, 22 aa, Artificial Sequence
  Description of Artificial Sequence: Synthetic peptide
  Seed: GDSSGTLISRALVVTHTYLEPG (PMEL_HUMAN)
  Core: RALVVTHTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISXALXVXHTXLEPG

SEQ ID NO: 327105 - protein, 22 aa, Artificial Sequence
  Description of Artificial Sequence: Synthetic peptide
  Seed: GDSSGTLISRALVVTHTYLEPG (PMEL_HUMAN)
  Core: LVVTHTYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRAXVVXHXYLXPG

SEQ ID NO: 327106 - protein, 22 aa, Artificial Sequence
  Description of Artificial Sequence: Synthetic peptide
  Seed: GDSSGTLISRALVVTHTYLEPG (PMEL_HUMAN)
  Core: VVTHTYLEP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALXVTXTXLEXG

SEQ ID NO: 327107 - protein, 23 aa, Artificial Sequence
  Description of Artificial Sequence: Synthetic peptide
  Seed: GDSSGTLISRALVVTHTYLEPGP (PMEL_HUMAN)
  Core: SSGTLISRA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GDXSGXLXSRXLVVTHTYLEPGP

SEQ ID NO: 327108 - protein, 23 aa, Artificial Sequence
  Description of Artificial Sequence: Synthetic peptide
  Seed: GDSSGTLISRALVVTHTYLEPGP (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYLEPGP

SEQ ID NO: 327109 - protein, 23 aa, Artificial Sequence
  Description of Artificial Sequence: Synthetic peptide
  Seed: GDSSGTLISRALVVTHTYLEPGP (PMEL_HUMAN)
  Core: RALVVTHTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISXALXVXHTXLEPGP

SEQ ID NO: 327110 - protein, 23 aa, Artificial Sequence
  Description of Artificial Sequence: Synthetic peptide
  Seed: GDSSGTLISRALVVTHTYLEPGP (PMEL_HUMAN)
  Core: LVVTHTYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRAXVVXHXYLXPGP

SEQ ID NO: 327111 - protein, 23 aa, Artificial Sequence
  Description of Artificial Sequence: Synthetic peptide
  Seed: GDSSGTLISRALVVTHTYLEPGP (PMEL_HUMAN)
  Core: VVTHTYLEP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALXVTXTXLEXGP

SEQ ID NO: 327112 - protein, 23 aa, Artificial Sequence
  Description of Artificial Sequence: Synthetic peptide
  Seed: GDSSGTLISRALVVTHTYLEPGP (PMEL_HUMAN)
  Core: VTHTYLEPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALVXTHXYXEPXP

SEQ ID NO: 327113 - protein, 24 aa, Artificial Sequence
  Description of Artificial Sequence: Synthetic peptide
  Seed: GDSSGTLISRALVVTHTYLEPGPV (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYLEPGPV

SEQ ID NO: 327114 - protein, 24 aa, Artificial Sequence
  Description of Artificial Sequence: Synthetic peptide
  Seed: GDSSGTLISRALVVTHTYLEPGPV (PMEL_HUMAN)
  Core: RALVVTHTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISXALXVXHTXLEPGPV

SEQ ID NO: 327115 - protein, 24 aa, Artificial Sequence
  Description of Artificial Sequence: Synthetic peptide
  Seed: GDSSGTLISRALVVTHTYLEPGPV (PMEL_HUMAN)
  Core: LVVTHTYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRAXVVXHXYLXPGPV

SEQ ID NO: 327116 - protein, 24 aa, Artificial Sequence
  Description of Artificial Sequence: Synthetic peptide
  Seed: GDSSGTLISRALVVTHTYLEPGPV (PMEL_HUMAN)
  Core: VVTHTYLEP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALXVTXTXLEXGPV

SEQ ID NO: 327117 - protein, 24 aa, Artificial Sequence
  Description of Artificial Sequence: Synthetic peptide
  Seed: GDSSGTLISRALVVTHTYLEPGPV (PMEL_HUMAN)
  Core: VTHTYLEPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALVXTHXYXEPXPV

SEQ ID NO: 327118 - protein, 25 aa, Artificial Sequence
  Description of Artificial Sequence: Synthetic peptide
  Seed: GDSSGTLISRALVVTHTYLEPGPVT (PMEL_HUMAN)
  Core: SRALVVTHT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLIXRAXVXTHXYLEPGPVT

SEQ ID NO: 327119 - protein, 25 aa, Artificial Sequence
  Description of Artificial Sequence: Synthetic peptide
  Seed: GDSSGTLISRALVVTHTYLEPGPVT (PMEL_HUMAN)
  Core: RALVVTHTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISXALXVXHTXLEPGPVT

SEQ ID NO: 327120 - protein, 25 aa, Artificial Sequence
  Description of Artificial Sequence: Synthetic peptide
  Seed: GDSSGTLISRALVVTHTYLEPGPVT (PMEL_HUMAN)
  Core: LVVTHTYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRAXVVXHXYLXPGPVT

SEQ ID NO: 327121 - protein, 25 aa, Artificial Sequence
  Description of Artificial Sequence: Synthetic peptide
  Seed: GDSSGTLISRALVVTHTYLEPGPVT (PMEL_HUMAN)
  Core: VVTHTYLEP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALXVTXTXLEXGPVT

SEQ ID NO: 327122 - protein, 25 aa, Artificial Sequence
  Description of Artificial Sequence: Synthetic peptide
  Seed: GDSSGTLISRALVVTHTYLEPGPVT (PMEL_HUMAN)
  Core: VTHTYLEPG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GDSSGTLISRALVXTHXYXEPXPVT

SEQ ID NO: 327123 - protein, 15 aa, Artificial Sequence
  Description of Artificial Sequence: Synthetic peptide
  Seed: GEGDAFELTVSCQGG (PMEL_HUMAN)
  Core: FELTVSCQG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAXELXVXCQXG

SEQ ID NO: 327124 - protein, 17 aa, Artificial Sequence
  Description of Artificial Sequence: Synthetic peptide
  Seed: GEGDAFELTVSCQGGLP (PMEL_HUMAN)
  Core: FELTVSCQG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAXELXVXCQXGLP

SEQ ID NO: 327125 - protein, 20 aa, Artificial Sequence
  Description of Artificial Sequence: Synthetic peptide
  Seed: GEGDAFELTVSCQGGLPKEA (PMEL_HUMAN)
  Core: FELTVSCQG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAXELXVXCQXGLPKEA

SEQ ID NO: 327126 - protein, 20 aa, Artificial Sequence
  Description of Artificial Sequence: Synthetic peptide
  Seed: GEGDAFELTVSCQGGLPKEA (PMEL_HUMAN)
  Core: CQGGLPKEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAFELTVSXQGXLXKEX

SEQ ID NO: 327127 - protein, 22 aa, Artificial Sequence
  Description of Artificial Sequence: Synthetic peptide
  Seed: GEGDAFELTVSCQGGLPKEACM (PMEL_HUMAN)
  Core: CQGGLPKEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAFELTVSXQGXLXKEXCM

SEQ ID NO: 327128 - protein, 23 aa, Artificial Sequence
  Description of Artificial Sequence: Synthetic peptide
  Seed: GEGDAFELTVSCQGGLPKEACME (PMEL_HUMAN)
  Core: CQGGLPKEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAFELTVSXQGXLXKEXCME

SEQ ID NO: 327129 - protein, 24 aa, Artificial Sequence
  Description of Artificial Sequence: Synthetic peptide
  Seed: GEGDAFELTVSCQGGLPKEACMEI (PMEL_HUMAN)
  Core: CQGGLPKEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAFELTVSXQGXLXKEXCMEI

SEQ ID NO: 327130 - protein, 25 aa, Artificial Sequence
  Description of Artificial Sequence: Synthetic peptide
  Seed: GEGDAFELTVSCQGGLPKEACMEIS (PMEL_HUMAN)
  Core: CQGGLPKEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GEGDAFELTVSXQGXLXKEXCMEIS

SEQ ID NO: 327131 - protein, 14 aa, Artificial Sequence
  Description of Artificial Sequence: Synthetic peptide
  Seed: GGNKHFLRNQPLTF (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTF

SEQ ID NO: 327132 - protein, 14 aa, Artificial Sequence
  Description of Artificial Sequence: Synthetic peptide
  Seed: GGNKHFLRNQPLTF (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTX

SEQ ID NO: 327133 - protein, 15 aa, Artificial Sequence
  Description of Artificial Sequence: Synthetic peptide
  Seed: GGNKHFLRNQPLTFA (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFA

SEQ ID NO: 327134 - protein, 15 aa, Artificial Sequence
  Description of Artificial Sequence: Synthetic peptide
  Seed: GGNKHFLRNQPLTFA (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXA

SEQ ID NO: 327135 - protein, 16 aa, Artificial Sequence
  Description of Artificial Sequence: Synthetic peptide
  Seed: GGNKHFLRNQPLTFAL (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFAL

SEQ ID NO: 327136 - protein, 16 aa, Artificial Sequence
  Description of Artificial Sequence: Synthetic peptide
  Seed: GGNKHFLRNQPLTFAL (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXAL

SEQ ID NO: 327137 - protein, 16 aa, Artificial Sequence
  Description of Artificial Sequence: Synthetic peptide
  Seed: GGNKHFLRNQPLTFAL (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXL

SEQ ID NO: 327138 - protein, 17 aa, Artificial Sequence
  Description of Artificial Sequence: Synthetic peptide
  Seed: GGNKHFLRNQPLTFALQ (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQ

SEQ ID NO: 327139 - protein, 17 aa, Artificial Sequence
  Description of Artificial Sequence: Synthetic peptide
  Seed: GGNKHFLRNQPLTFALQ (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQ

SEQ ID NO: 327140 - protein, 17 aa, Artificial Sequence
  Description of Artificial Sequence: Synthetic peptide
  Seed: GGNKHFLRNQPLTFALQ (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQ

SEQ ID NO: 327141 - protein, 18 aa, Artificial Sequence
  Description of Artificial Sequence: Synthetic peptide
  Seed: GGNKHFLRNQPLTFALQL (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQL

SEQ ID NO: 327142 - protein, 18 aa, Artificial Sequence
  Description of Artificial Sequence: Synthetic peptide
  Seed: GGNKHFLRNQPLTFALQL (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQL

SEQ ID NO: 327143 - protein, 18 aa, Artificial Sequence
  Description of Artificial Sequence: Synthetic peptide
  Seed: GGNKHFLRNQPLTFALQL (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQL

SEQ ID NO: 327144 - protein, 19 aa, Artificial Sequence
  Description of Artificial Sequence: Synthetic peptide
  Seed: GGNKHFLRNQPLTFALQLH (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLH

SEQ ID NO: 327145 - protein, 19 aa, Artificial Sequence
  Description of Artificial Sequence: Synthetic peptide
  Seed: GGNKHFLRNQPLTFALQLH (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLH

SEQ ID NO: 327146 - protein, 19 aa, Artificial Sequence
  Description of Artificial Sequence: Synthetic peptide
  Seed: GGNKHFLRNQPLTFALQLH (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQLH

SEQ ID NO: 327147 - protein, 19 aa, Artificial Sequence
  Description of Artificial Sequence: Synthetic peptide
  Seed: GGNKHFLRNQPLTFALQLH (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLH

SEQ ID NO: 327148 - protein, 20 aa, Artificial Sequence
  Description of Artificial Sequence: Synthetic peptide
  Seed: GGNKHFLRNQPLTFALQLHD (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLHD

SEQ ID NO: 327149 - protein, 20 aa, Artificial Sequence
  Description of Artificial Sequence: Synthetic peptide
  Seed: GGNKHFLRNQPLTFALQLHD (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLHD

SEQ ID NO: 327150 - protein, 20 aa, Artificial Sequence
  Description of Artificial Sequence: Synthetic peptide
  Seed: GGNKHFLRNQPLTFALQLHD (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQLHD

SEQ ID NO: 327151 - protein, 20 aa, Artificial Sequence
  Description of Artificial Sequence: Synthetic peptide
  Seed: GGNKHFLRNQPLTFALQLHD (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLHD

SEQ ID NO: 327152 - protein, 20 aa, Artificial Sequence
  Description of Artificial Sequence: Synthetic peptide
  Seed: GGNKHFLRNQPLTFALQLHD (PMEL_HUMAN)
  Core: PLTFALQLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQXLTXAXQLXD

SEQ ID NO: 327153 - protein, 21 aa, Artificial Sequence
  Description of Artificial Sequence: Synthetic peptide
  Seed: GGNKHFLRNQPLTFALQLHDP (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLHDP

SEQ ID NO: 327154 - protein, 21 aa, Artificial Sequence
  Description of Artificial Sequence: Synthetic peptide
  Seed: GGNKHFLRNQPLTFALQLHDP (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLHDP

SEQ ID NO: 327155 - protein, 21 aa, Artificial Sequence
  Description of Artificial Sequence: Synthetic peptide
  Seed: GGNKHFLRNQPLTFALQLHDP (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQLHDP

SEQ ID NO: 327156 - protein, 21 aa, Artificial Sequence
  Description of Artificial Sequence: Synthetic peptide
  Seed: GGNKHFLRNQPLTFALQLHDP (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLHDP

SEQ ID NO: 327157 - protein, 21 aa, Artificial Sequence
  Description of Artificial Sequence: Synthetic peptide
  Seed: GGNKHFLRNQPLTFALQLHDP (PMEL_HUMAN)
  Core: PLTFALQLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQXLTXAXQLXDP

SEQ ID NO: 327158 - protein, 21 aa, Artificial Sequence
  Description of Artificial Sequence: Synthetic peptide
  Seed: GGNKHFLRNQPLTFALQLHDP (PMEL_HUMAN)
  Core: LTFALQLHD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPXTFXLXLHXP

SEQ ID NO: 327159 - protein, 22 aa, Artificial Sequence
  Description of Artificial Sequence: Synthetic peptide
  Seed: GGNKHFLRNQPLTFALQLHDPS (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLHDPS

SEQ ID NO: 327160 - protein, 22 aa, Artificial Sequence
  Description of Artificial Sequence: Synthetic peptide
  Seed: GGNKHFLRNQPLTFALQLHDPS (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLHDPS

SEQ ID NO: 327161 - protein, 22 aa, Artificial Sequence
  Description of Artificial Sequence: Synthetic peptide
  Seed: GGNKHFLRNQPLTFALQLHDPS (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQLHDPS

SEQ ID NO: 327162 - protein, 22 aa, Artificial Sequence
  Description of Artificial Sequence: Synthetic peptide
  Seed: GGNKHFLRNQPLTFALQLHDPS (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLHDPS

SEQ ID NO: 327163 - protein, 22 aa, Artificial Sequence
  Description of Artificial Sequence: Synthetic peptide
  Seed: GGNKHFLRNQPLTFALQLHDPS (PMEL_HUMAN)
  Core: PLTFALQLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQXLTXAXQLXDPS

SEQ ID NO: 327164 - protein, 22 aa, Artificial Sequence
  Description of Artificial Sequence: Synthetic peptide
  Seed: GGNKHFLRNQPLTFALQLHDPS (PMEL_HUMAN)
  Core: LTFALQLHD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPXTFXLXLHXPS

SEQ ID NO: 327165 - protein, 23 aa, Artificial Sequence
  Description of Artificial Sequence: Synthetic peptide
  Seed: GGNKHFLRNQPLTFALQLHDPSG (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLHDPSG

SEQ ID NO: 327166 - protein, 23 aa, Artificial Sequence
  Description of Artificial Sequence: Synthetic peptide
  Seed: GGNKHFLRNQPLTFALQLHDPSG (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLHDPSG

SEQ ID NO: 327167 - protein, 23 aa, Artificial Sequence
  Description of Artificial Sequence: Synthetic peptide
  Seed: GGNKHFLRNQPLTFALQLHDPSG (PMEL_HUMAN)
  Core: LRNQPLTFA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFXRNXPXTFXLQLHDPSG

SEQ ID NO: 327168 - protein, 23 aa, Artificial Sequence
  Description of Artificial Sequence: Synthetic peptide
  Seed: GGNKHFLRNQPLTFALQLHDPSG (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLHDPSG

SEQ ID NO: 327169 - protein, 23 aa, Artificial Sequence
  Description of Artificial Sequence: Synthetic peptide
  Seed: GGNKHFLRNQPLTFALQLHDPSG (PMEL_HUMAN)
  Core: PLTFALQLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQXLTXAXQLXDPSG

SEQ ID NO: 327170 - protein, 23 aa, Artificial Sequence
  Description of Artificial Sequence: Synthetic peptide
  Seed: GGNKHFLRNQPLTFALQLHDPSG (PMEL_HUMAN)
  Core: LTFALQLHD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPXTFXLXLHXPSG

SEQ ID NO: 327171 - protein, 24 aa, Artificial Sequence
  Description of Artificial Sequence: Synthetic peptide
  Seed: GGNKHFLRNQPLTFALQLHDPSGY (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLHDPSGY

SEQ ID NO: 327172 - protein, 24 aa, Artificial Sequence
  Description of Artificial Sequence: Synthetic peptide
  Seed: GGNKHFLRNQPLTFALQLHDPSGY (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLHDPSGY

SEQ ID NO: 327173 - protein, 24 aa, Artificial Sequence
  Description of Artificial Sequence: Synthetic peptide
  Seed: GGNKHFLRNQPLTFALQLHDPSGY (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLHDPSGY

SEQ ID NO: 327174 - protein, 24 aa, Artificial Sequence
  Description of Artificial Sequence: Synthetic peptide
  Seed: GGNKHFLRNQPLTFALQLHDPSGY (PMEL_HUMAN)
  Core: PLTFALQLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQXLTXAXQLXDPSGY

SEQ ID NO: 327175 - protein, 24 aa, Artificial Sequence
  Description of Artificial Sequence: Synthetic peptide
  Seed: GGNKHFLRNQPLTFALQLHDPSGY (PMEL_HUMAN)
  Core: LTFALQLHD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPXTFXLXLHXPSGY

SEQ ID NO: 327176 - protein, 24 aa, Artificial Sequence
  Description of Artificial Sequence: Synthetic peptide
  Seed: GGNKHFLRNQPLTFALQLHDPSGY (PMEL_HUMAN)
  Core: FALQLHDPS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPLTXALXLXDPXGY

SEQ ID NO: 327177 - protein, 25 aa, Artificial Sequence
  Description of Artificial Sequence: Synthetic peptide
  Seed: GGNKHFLRNQPLTFALQLHDPSGYL (PMEL_HUMAN)
  Core: KHFLRNQPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGNXHFXRXQPXTFALQLHDPSGYL

SEQ ID NO: 327178 - protein, 25 aa, Artificial Sequence
  Description of Artificial Sequence: Synthetic peptide
  Seed: GGNKHFLRNQPLTFALQLHDPSGYL (PMEL_HUMAN)
  Core: FLRNQPLTF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHXLRXQXLTXALQLHDPSGYL

SEQ ID NO: 327179 - protein, 25 aa, Artificial Sequence
  Description of Artificial Sequence: Synthetic peptide
  Seed: GGNKHFLRNQPLTFALQLHDPSGYL (PMEL_HUMAN)
  Core: RNQPLTFAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLXNQXLXFAXQLHDPSGYL

SEQ ID NO: 327180 - protein, 25 aa, Artificial Sequence
  Description of Artificial Sequence: Synthetic peptide
  Seed: GGNKHFLRNQPLTFALQLHDPSGYL (PMEL_HUMAN)
  Core: PLTFALQLH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQXLTXAXQLXDPSGYL

SEQ ID NO: 327181 - protein, 25 aa, Artificial Sequence
  Description of Artificial Sequence: Synthetic peptide
  Seed: GGNKHFLRNQPLTFALQLHDPSGYL (PMEL_HUMAN)
  Core: LTFALQLHD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPXTFXLXLHXPSGYL

SEQ ID NO: 327182 - protein, 25 aa, Artificial Sequence
  Description of Artificial Sequence: Synthetic peptide
  Seed: GGNKHFLRNQPLTFALQLHDPSGYL (PMEL_HUMAN)
  Core: FALQLHDPS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GGNKHFLRNQPLTXALXLXDPXGYL

SEQ ID NO: 327183 - protein, 20 aa, Artificial Sequence
  Description of Artificial Sequence: Synthetic peptide
  Seed: GGPCPSGSWSQKRSFVYVWK (PMEL_HUMAN)
  Core: WSQKRSFVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSXSQXRXFVXVWK

SEQ ID NO: 327184 - protein, 21 aa, Artificial Sequence
  Description of Artificial Sequence: Synthetic peptide
  Seed: GGPCPSGSWSQKRSFVYVWKT (PMEL_HUMAN)
  Core: WSQKRSFVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSXSQXRXFVXVWKT

SEQ ID NO: 327185 - protein, 22 aa, Artificial Sequence
  Description of Artificial Sequence: Synthetic peptide
  Seed: GGPCPSGSWSQKRSFVYVWKTW (PMEL_HUMAN)
  Core: WSQKRSFVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSXSQXRXFVXVWKTW

SEQ ID NO: 327186 - protein, 22 aa, Artificial Sequence
  Description of Artificial Sequence: Synthetic peptide
  Seed: GGPCPSGSWSQKRSFVYVWKTW (PMEL_HUMAN)
  Core: RSFVYVWKT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKXSFXYXWKXW

SEQ ID NO: 327187 - protein, 23 aa, Artificial Sequence
  Description of Artificial Sequence: Synthetic peptide
  Seed: GGPCPSGSWSQKRSFVYVWKTWG (PMEL_HUMAN)
  Core: WSQKRSFVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSXSQXRXFVXVWKTWG

SEQ ID NO: 327188 - protein, 23 aa, Artificial Sequence
  Description of Artificial Sequence: Synthetic peptide
  Seed: GGPCPSGSWSQKRSFVYVWKTWG (PMEL_HUMAN)
  Core: RSFVYVWKT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKXSFXYXWKXWG

SEQ ID NO: 327189 - protein, 24 aa, Artificial Sequence
  Description of Artificial Sequence: Synthetic peptide
  Seed: GGPCPSGSWSQKRSFVYVWKTWGQ (PMEL_HUMAN)
  Core: WSQKRSFVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSXSQXRXFVXVWKTWGQ

SEQ ID NO: 327190 - protein, 24 aa, Artificial Sequence
  Description of Artificial Sequence: Synthetic peptide
  Seed: GGPCPSGSWSQKRSFVYVWKTWGQ (PMEL_HUMAN)
  Core: RSFVYVWKT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKXSFXYXWKXWGQ

SEQ ID NO: 327191 - protein, 24 aa, Artificial Sequence
  Description of Artificial Sequence: Synthetic peptide
  Seed: GGPCPSGSWSQKRSFVYVWKTWGQ (PMEL_HUMAN)
  Core: FVYVWKTWG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKRSXVYXWXTWXQ

SEQ ID NO: 327192 - protein, 24 aa, Artificial Sequence
  Description of Artificial Sequence: Synthetic peptide
  Seed: GGPCPSGSWSQKRSFVYVWKTWGQ (PMEL_HUMAN)
  Core: VYVWKTWGQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKRSFXYVXKXWGX

SEQ ID NO: 327193 - protein, 25 aa, Artificial Sequence
  Description of Artificial Sequence: Synthetic peptide
  Seed: GGPCPSGSWSQKRSFVYVWKTWGQY (PMEL_HUMAN)
  Core: WSQKRSFVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSXSQXRXFVXVWKTWGQY

SEQ ID NO: 327194 - protein, 25 aa, Artificial Sequence
  Description of Artificial Sequence: Synthetic peptide
  Seed: GGPCPSGSWSQKRSFVYVWKTWGQY (PMEL_HUMAN)
  Core: RSFVYVWKT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKXSFXYXWKXWGQY

SEQ ID NO: 327195 - protein, 25 aa, Artificial Sequence
  Description of Artificial Sequence: Synthetic peptide
  Seed: GGPCPSGSWSQKRSFVYVWKTWGQY (PMEL_HUMAN)
  Core: FVYVWKTWG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKRSXVYXWXTWXQY

SEQ ID NO: 327196 - protein, 25 aa, Artificial Sequence
  Description of Artificial Sequence: Synthetic peptide
  Seed: GGPCPSGSWSQKRSFVYVWKTWGQY (PMEL_HUMAN)
  Core: VYVWKTWGQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GGPCPSGSWSQKRSFXYVXKXWGXY

SEQ ID NO: 327197 - protein, 13 aa, Artificial Sequence
  Description of Artificial Sequence: Synthetic peptide
  Seed: GGPVSGLSIGTGR (PMEL_HUMAN)
  Core: PVSGLSIGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXVSXLXIGXGR

SEQ ID NO: 327198 - protein, 14 aa, Artificial Sequence
  Description of Artificial Sequence: Synthetic peptide
  Seed: GGPVSGLSIGTGRA (PMEL_HUMAN)
  Core: PVSGLSIGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXVSXLXIGXGRA

SEQ ID NO: 327199 - protein, 15 aa, Artificial Sequence
  Description of Artificial Sequence: Synthetic peptide
  Seed: GGPVSGLSIGTGRAM (PMEL_HUMAN)
  Core: PVSGLSIGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXVSXLXIGXGRAM

SEQ ID NO: 327200 - protein, 15 aa, Artificial Sequence
  Description of Artificial Sequence: Synthetic peptide
  Seed: GGPVSGLSIGTGRAM (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAM

SEQ ID NO: 327201 - protein, 15 aa, Artificial Sequence
  Description of Artificial Sequence: Synthetic peptide
  Seed: GGPVSGLSIGTGRAM (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAX

SEQ ID NO: 327202 - protein, 16 aa, Artificial Sequence
  Description of Artificial Sequence: Synthetic peptide
  Seed: GGPVSGLSIGTGRAML (PMEL_HUMAN)
  Core: PVSGLSIGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXVSXLXIGXGRAML

SEQ ID NO: 327203 - protein, 16 aa, Artificial Sequence
  Description of Artificial Sequence: Synthetic peptide
  Seed: GGPVSGLSIGTGRAML (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAML

SEQ ID NO: 327204 - protein, 16 aa, Artificial Sequence
  Description of Artificial Sequence: Synthetic peptide
  Seed: GGPVSGLSIGTGRAML (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXL

SEQ ID NO: 327205 - protein, 17 aa, Artificial Sequence
  Description of Artificial Sequence: Synthetic peptide
  Seed: GGPVSGLSIGTGRAMLG (PMEL_HUMAN)
  Core: PVSGLSIGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GGXVSXLXIGXGRAMLG

SEQ ID NO: 327206 - protein, 17 aa, Artificial Sequence
  Description of Artificial Sequence: Synthetic peptide
  Seed: GGPVSGLSIGTGRAMLG (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAMLG

SEQ ID NO: 327207 - protein, 17 aa, Artificial Sequence
  Description of Artificial Sequence: Synthetic peptide
  Seed: GGPVSGLSIGTGRAMLG (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLG

SEQ ID NO: 327208 - protein, 18 aa, Artificial Sequence
  Description of Artificial Sequence: Synthetic peptide
  Seed: GGPVSGLSIGTGRAMLGT (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAMLGT

SEQ ID NO: 327209 - protein, 18 aa, Artificial Sequence
  Description of Artificial Sequence: Synthetic peptide
  Seed: GGPVSGLSIGTGRAMLGT (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXT

SEQ ID NO: 327210 - protein, 19 aa, Artificial Sequence
  Description of Artificial Sequence: Synthetic peptide
  Seed: GGPVSGLSIGTGRAMLGTH (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTH

SEQ ID NO: 327211 - protein, 19 aa, Artificial Sequence
  Description of Artificial Sequence: Synthetic peptide
  Seed: GGPVSGLSIGTGRAMLGTH (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTH

SEQ ID NO: 327212 - protein, 20 aa, Artificial Sequence
  Description of Artificial Sequence: Synthetic peptide
  Seed: GGPVSGLSIGTGRAMLGTHT (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAMLGTHT

SEQ ID NO: 327213 - protein, 20 aa, Artificial Sequence
  Description of Artificial Sequence: Synthetic peptide
  Seed: GGPVSGLSIGTGRAMLGTHT (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTHT

SEQ ID NO: 327214 - protein, 20 aa, Artificial Sequence
  Description of Artificial Sequence: Synthetic peptide
  Seed: GGPVSGLSIGTGRAMLGTHT (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTHT

SEQ ID NO: 327215 - protein, 21 aa, Artificial Sequence
  Description of Artificial Sequence: Synthetic peptide
  Seed: GGPVSGLSIGTGRAMLGTHTM (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTHTM

SEQ ID NO: 327216 - protein, 21 aa, Artificial Sequence
  Description of Artificial Sequence: Synthetic peptide
  Seed: GGPVSGLSIGTGRAMLGTHTM (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTHTM

SEQ ID NO: 327217 - protein, 22 aa, Artificial Sequence
  Description of Artificial Sequence: Synthetic peptide
  Seed: GGPVSGLSIGTGRAMLGTHTME (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTHTME

SEQ ID NO: 327218 - protein, 22 aa, Artificial Sequence
  Description of Artificial Sequence: Synthetic peptide
  Seed: GGPVSGLSIGTGRAMLGTHTME (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTHTME

SEQ ID NO: 327219 - protein, 23 aa, Artificial Sequence
  Description of Artificial Sequence: Synthetic peptide
  Seed: GGPVSGLSIGTGRAMLGTHTMEV (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTHTMEV

SEQ ID NO: 327220 - protein, 23 aa, Artificial Sequence
  Description of Artificial Sequence: Synthetic peptide
  Seed: GGPVSGLSIGTGRAMLGTHTMEV (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTHTMEV

SEQ ID NO: 327221 - protein, 23 aa, Artificial Sequence
  Description of Artificial Sequence: Synthetic peptide
  Seed: GGPVSGLSIGTGRAMLGTHTMEV (PMEL_HUMAN)
  Core: MLGTHTMEV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSIGTGRAXLGXHXMEX

SEQ ID NO: 327222 - protein, 24 aa, Artificial Sequence
  Description of Artificial Sequence: Synthetic peptide
  Seed: GGPVSGLSIGTGRAMLGTHTMEVT (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAMLGTHTMEVT

SEQ ID NO: 327223 - protein, 24 aa, Artificial Sequence
  Description of Artificial Sequence: Synthetic peptide
  Seed: GGPVSGLSIGTGRAMLGTHTMEVT (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTHTMEVT

SEQ ID NO: 327224 - protein, 24 aa, Artificial Sequence
  Description of Artificial Sequence: Synthetic peptide
  Seed: GGPVSGLSIGTGRAMLGTHTMEVT (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTHTMEVT

SEQ ID NO: 327225 - protein, 24 aa, Artificial Sequence
  Description of Artificial Sequence: Synthetic peptide
  Seed: GGPVSGLSIGTGRAMLGTHTMEVT (PMEL_HUMAN)
  Core: RAMLGTHTM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSIGTGXAMXGXHTXEVT

SEQ ID NO: 327226 - protein, 24 aa, Artificial Sequence
  Description of Artificial Sequence: Synthetic peptide
  Seed: GGPVSGLSIGTGRAMLGTHTMEVT (PMEL_HUMAN)
  Core: MLGTHTMEV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSIGTGRAXLGXHXMEXT

SEQ ID NO: 327227 - protein, 25 aa, Artificial Sequence
  Description of Artificial Sequence: Synthetic peptide
  Seed: GGPVSGLSIGTGRAMLGTHTMEVTV (PMEL_HUMAN)
  Core: VSGLSIGTG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GGPXSGXSXGTXRAMLGTHTMEVTV

SEQ ID NO: 327228 - protein, 25 aa, Artificial Sequence
  Description of Artificial Sequence: Synthetic peptide
  Seed: GGPVSGLSIGTGRAMLGTHTMEVTV (PMEL_HUMAN)
  Core: LSIGTGRAM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGXSIXTXRAXLGTHTMEVTV

SEQ ID NO: 327229 - protein, 25 aa, Artificial Sequence
  Description of Artificial Sequence: Synthetic peptide
  Seed: GGPVSGLSIGTGRAMLGTHTMEVTV (PMEL_HUMAN)
  Core: IGTGRAMLG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSXGTXRXMLXTHTMEVTV

SEQ ID NO: 327230 - protein, 25 aa, Artificial Sequence
  Description of Artificial Sequence: Synthetic peptide
  Seed: GGPVSGLSIGTGRAMLGTHTMEVTV (PMEL_HUMAN)
  Core: RAMLGTHTM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSIGTGXAMXGXHTXEVTV

SEQ ID NO: 327231 - protein, 25 aa, Artificial Sequence
  Description of Artificial Sequence: Synthetic peptide
  Seed: GGPVSGLSIGTGRAMLGTHTMEVTV (PMEL_HUMAN)
  Core: MLGTHTMEV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGPVSGLSIGTGRAXLGXHXMEXTV

SEQ ID NO: 327232 - protein, 16 aa, Artificial Sequence
  Description of Artificial Sequence: Synthetic peptide
  Seed: GGQVSLKVSNDGPTLI (PMEL_HUMAN)
  Core: LKVSNDGPT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSXKVXNXGPXLI

SEQ ID NO: 327233 - protein, 19 aa, Artificial Sequence
  Description of Artificial Sequence: Synthetic peptide
  Seed: GGQVSLKVSNDGPTLIGAN (PMEL_HUMAN)
  Core: VSNDGPTLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKXSNXGXTLXGAN

SEQ ID NO: 327234 - protein, 20 aa, Artificial Sequence
  Description of Artificial Sequence: Synthetic peptide
  Seed: GGQVSLKVSNDGPTLIGANA (PMEL_HUMAN)
  Core: LKVSNDGPT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSXKVXNXGPXLIGANA

SEQ ID NO: 327235 - protein, 20 aa, Artificial Sequence
  Description of Artificial Sequence: Synthetic peptide
  Seed: GGQVSLKVSNDGPTLIGANA (PMEL_HUMAN)
  Core: VSNDGPTLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKXSNXGXTLXGANA

SEQ ID NO: 327236 - protein, 21 aa, Artificial Sequence
  Description of Artificial Sequence: Synthetic peptide
  Seed: GGQVSLKVSNDGPTLIGANAS (PMEL_HUMAN)
  Core: VSNDGPTLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKXSNXGXTLXGANAS

SEQ ID NO: 327237 - protein, 22 aa, Artificial Sequence
  Description of Artificial Sequence: Synthetic peptide
  Seed: GGQVSLKVSNDGPTLIGANASF (PMEL_HUMAN)
  Core: VSNDGPTLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKXSNXGXTLXGANASF

SEQ ID NO: 327238 - protein, 23 aa, Artificial Sequence
  Description of Artificial Sequence: Synthetic peptide
  Seed: GGQVSLKVSNDGPTLIGANASFS (PMEL_HUMAN)
  Core: LKVSNDGPT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSXKVXNXGPXLIGANASFS

SEQ ID NO: 327239 - protein, 23 aa, Artificial Sequence
  Description of Artificial Sequence: Synthetic peptide
  Seed: GGQVSLKVSNDGPTLIGANASFS (PMEL_HUMAN)
  Core: VSNDGPTLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKXSNXGXTLXGANASFS

SEQ ID NO: 327240 - protein, 23 aa, Artificial Sequence
  Description of Artificial Sequence: Synthetic peptide
  Seed: GGQVSLKVSNDGPTLIGANASFS (PMEL_HUMAN)
  Core: PTLIGANAS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGXTLXGXNAXFS

SEQ ID NO: 327241 - protein, 23 aa, Artificial Sequence
  Description of Artificial Sequence: Synthetic peptide
  Seed: GGQVSLKVSNDGPTLIGANASFS (PMEL_HUMAN)
  Core: LIGANASFS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGPTXIGXNXSFX

SEQ ID NO: 327242 - protein, 24 aa, Artificial Sequence
  Description of Artificial Sequence: Synthetic peptide
  Seed: GGQVSLKVSNDGPTLIGANASFSI (PMEL_HUMAN)
  Core: LKVSNDGPT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSXKVXNXGPXLIGANASFSI

SEQ ID NO: 327243 - protein, 24 aa, Artificial Sequence
  Description of Artificial Sequence: Synthetic peptide
  Seed: GGQVSLKVSNDGPTLIGANASFSI (PMEL_HUMAN)
  Core: VSNDGPTLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKXSNXGXTLXGANASFSI

SEQ ID NO: 327244 - protein, 24 aa, Artificial Sequence
  Description of Artificial Sequence: Synthetic peptide
  Seed: GGQVSLKVSNDGPTLIGANASFSI (PMEL_HUMAN)
  Core: PTLIGANAS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGXTLXGXNAXFSI

SEQ ID NO: 327245 - protein, 24 aa, Artificial Sequence
  Description of Artificial Sequence: Synthetic peptide
  Seed: GGQVSLKVSNDGPTLIGANASFSI (PMEL_HUMAN)
  Core: LIGANASFS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGPTXIGXNXSFXI

SEQ ID NO: 327246 - protein, 25 aa, Artificial Sequence
  Description of Artificial Sequence: Synthetic peptide
  Seed: GGQVSLKVSNDGPTLIGANASFSIA (PMEL_HUMAN)
  Core: LKVSNDGPT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSXKVXNXGPXLIGANASFSIA

SEQ ID NO: 327247 - protein, 25 aa, Artificial Sequence
  Description of Artificial Sequence: Synthetic peptide
  Seed: GGQVSLKVSNDGPTLIGANASFSIA (PMEL_HUMAN)
  Core: PTLIGANAS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGXTLXGXNAXFSIA

SEQ ID NO: 327248 - protein, 25 aa, Artificial Sequence
  Description of Artificial Sequence: Synthetic peptide
  Seed: GGQVSLKVSNDGPTLIGANASFSIA (PMEL_HUMAN)
  Core: LIGANASFS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGPTXIGXNXSFXIA

SEQ ID NO: 327249 - protein, 25 aa, Artificial Sequence
  Description of Artificial Sequence: Synthetic peptide
  Seed: GGQVSLKVSNDGPTLIGANASFSIA (PMEL_HUMAN)
  Core: IGANASFSI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GGQVSLKVSNDGPTLXGAXAXFSXA

SEQ ID NO: 327250 - protein, 14 aa, Artificial Sequence
  Description of Artificial Sequence: Synthetic peptide
  Seed: GGSGTYCLNVSLAD (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAX

SEQ ID NO: 327251 - protein, 15 aa, Artificial Sequence
  Description of Artificial Sequence: Synthetic peptide
  Seed: GGSGTYCLNVSLADT (PMEL_HUMAN)
  Core: TYCLNVSLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GGSGXYCXNXSLXDT

SEQ ID NO: 327252 - protein, 15 aa, Artificial Sequence
  Description of Artificial Sequence: Synthetic peptide
  Seed: GGSGTYCLNVSLADT (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXT

SEQ ID NO: 327253 - protein, 16 aa, Artificial Sequence
  Description of Artificial Sequence: Synthetic peptide
  Seed: GGSGTYCLNVSLADTN (PMEL_HUMAN)
  Core: TYCLNVSLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GGSGXYCXNXSLXDTN

SEQ ID NO: 327254 - protein, 16 aa, Artificial Sequence
  Description of Artificial Sequence: Synthetic peptide
  Seed: GGSGTYCLNVSLADTN (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTN

SEQ ID NO: 327255 - protein, 17 aa, Artificial Sequence
  Description of Artificial Sequence: Synthetic peptide
  Seed: GGSGTYCLNVSLADTNS (PMEL_HUMAN)
  Core: TYCLNVSLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GGSGXYCXNXSLXDTNS

SEQ ID NO: 327256 - protein, 17 aa, Artificial Sequence
  Description of Artificial Sequence: Synthetic peptide
  Seed: GGSGTYCLNVSLADTNS (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNS

SEQ ID NO: 327257 - protein, 18 aa, Artificial Sequence
  Description of Artificial Sequence: Synthetic peptide
  Seed: GGSGTYCLNVSLADTNSL (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSL

SEQ ID NO: 327258 - protein, 19 aa, Artificial Sequence
  Description of Artificial Sequence: Synthetic peptide
  Seed: GGSGTYCLNVSLADTNSLA (PMEL_HUMAN)
  Core: TYCLNVSLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GGSGXYCXNXSLXDTNSLA

SEQ ID NO: 327259 - protein, 19 aa, Artificial Sequence
  Description of Artificial Sequence: Synthetic peptide
  Seed: GGSGTYCLNVSLADTNSLA (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLA

SEQ ID NO: 327260 - protein, 19 aa, Artificial Sequence
  Description of Artificial Sequence: Synthetic peptide
  Seed: GGSGTYCLNVSLADTNSLA (PMEL_HUMAN)
  Core: VSLADTNSL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNXSLXDXNSXA

SEQ ID NO: 327261 - protein, 20 aa, Artificial Sequence
  Description of Artificial Sequence: Synthetic peptide
  Seed: GGSGTYCLNVSLADTNSLAV (PMEL_HUMAN)
  Core: TYCLNVSLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GGSGXYCXNXSLXDTNSLAV

SEQ ID NO: 327262 - protein, 20 aa, Artificial Sequence
  Description of Artificial Sequence: Synthetic peptide
  Seed: GGSGTYCLNVSLADTNSLAV (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLAV

SEQ ID NO: 327263 - protein, 20 aa, Artificial Sequence
  Description of Artificial Sequence: Synthetic peptide
  Seed: GGSGTYCLNVSLADTNSLAV (PMEL_HUMAN)
  Core: LNVSLADTN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCXNVXLXDTXSLAV

SEQ ID NO: 327264 - protein, 20 aa, Artificial Sequence
  Description of Artificial Sequence: Synthetic peptide
  Seed: GGSGTYCLNVSLADTNSLAV (PMEL_HUMAN)
  Core: NVSLADTNS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLXVSXAXTNXLAV

SEQ ID NO: 327265 - protein, 20 aa, Artificial Sequence
  Description of Artificial Sequence: Synthetic peptide
  Seed: GGSGTYCLNVSLADTNSLAV (PMEL_HUMAN)
  Core: VSLADTNSL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNXSLXDXNSXAV

SEQ ID NO: 327266 - protein, 20 aa, Artificial Sequence
  Description of Artificial Sequence: Synthetic peptide
  Seed: GGSGTYCLNVSLADTNSLAV (PMEL_HUMAN)
  Core: LADTNSLAV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSXADXNXLAX

SEQ ID NO: 327267 - protein, 21 aa, Artificial Sequence
  Description of Artificial Sequence: Synthetic peptide
  Seed: GGSGTYCLNVSLADTNSLAVV (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLAVV

SEQ ID NO: 327268 - protein, 21 aa, Artificial Sequence
  Description of Artificial Sequence: Synthetic peptide
  Seed: GGSGTYCLNVSLADTNSLAVV (PMEL_HUMAN)
  Core: LADTNSLAV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSXADXNXLAXV

SEQ ID NO: 327269 - protein, 22 aa, Artificial Sequence
  Description of Artificial Sequence: Synthetic peptide
  Seed: GGSGTYCLNVSLADTNSLAVVS (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLAVVS

SEQ ID NO: 327270 - protein, 22 aa, Artificial Sequence
  Description of Artificial Sequence: Synthetic peptide
  Seed: GGSGTYCLNVSLADTNSLAVVS (PMEL_HUMAN)
  Core: LADTNSLAV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSXADXNXLAXVS

SEQ ID NO: 327271 - protein, 23 aa, Artificial Sequence
  Description of Artificial Sequence: Synthetic peptide
  Seed: GGSGTYCLNVSLADTNSLAVVST (PMEL_HUMAN)
  Core: TYCLNVSLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GGSGXYCXNXSLXDTNSLAVVST

SEQ ID NO: 327272 - protein, 23 aa, Artificial Sequence
  Description of Artificial Sequence: Synthetic peptide
  Seed: GGSGTYCLNVSLADTNSLAVVST (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLAVVST

SEQ ID NO: 327273 - protein, 23 aa, Artificial Sequence
  Description of Artificial Sequence: Synthetic peptide
  Seed: GGSGTYCLNVSLADTNSLAVVST (PMEL_HUMAN)
  Core: LADTNSLAV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSXADXNXLAXVST

SEQ ID NO: 327274 - protein, 24 aa, Artificial Sequence
  Description of Artificial Sequence: Synthetic peptide
  Seed: GGSGTYCLNVSLADTNSLAVVSTQ (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLAVVSTQ

SEQ ID NO: 327275 - protein, 24 aa, Artificial Sequence
  Description of Artificial Sequence: Synthetic peptide
  Seed: GGSGTYCLNVSLADTNSLAVVSTQ (PMEL_HUMAN)
  Core: LADTNSLAV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSXADXNXLAXVSTQ

SEQ ID NO: 327276 - protein, 24 aa, Artificial Sequence
  Description of Artificial Sequence: Synthetic peptide
  Seed: GGSGTYCLNVSLADTNSLAVVSTQ (PMEL_HUMAN)
  Core: DTNSLAVVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSLAXTNXLXVVXTQ

SEQ ID NO: 327277 - protein, 25 aa, Artificial Sequence
  Description of Artificial Sequence: Synthetic peptide
  Seed: GGSGTYCLNVSLADTNSLAVVSTQL (PMEL_HUMAN)
  Core: YCLNVSLAD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTXCLXVXLAXTNSLAVVSTQL

SEQ ID NO: 327278 - protein, 25 aa, Artificial Sequence
  Description of Artificial Sequence: Synthetic peptide
  Seed: GGSGTYCLNVSLADTNSLAVVSTQL (PMEL_HUMAN)
  Core: LADTNSLAV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSXADXNXLAXVSTQL

SEQ ID NO: 327279 - protein, 25 aa, Artificial Sequence
  Description of Artificial Sequence: Synthetic peptide
  Seed: GGSGTYCLNVSLADTNSLAVVSTQL (PMEL_HUMAN)
  Core: DTNSLAVVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSLAXTNXLXVVXTQL

SEQ ID NO: 327280 - protein, 25 aa, Artificial Sequence
  Description of Artificial Sequence: Synthetic peptide
  Seed: GGSGTYCLNVSLADTNSLAVVSTQL (PMEL_HUMAN)
  Core: NSLAVVSTQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GGSGTYCLNVSLADTXSLXVXSTXL

SEQ ID NO: 327281 - protein, 19 aa, Artificial Sequence
  Description of Artificial Sequence: Synthetic peptide
  Seed: GHRPTAEAPNTTAGQVPTT (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTX

SEQ ID NO: 327282 - protein, 20 aa, Artificial Sequence
  Description of Artificial Sequence: Synthetic peptide
  Seed: GHRPTAEAPNTTAGQVPTTE (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTXE

SEQ ID NO: 327283 - protein, 21 aa, Artificial Sequence
  Description of Artificial Sequence: Synthetic peptide
  Seed: GHRPTAEAPNTTAGQVPTTEV (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTXEV

SEQ ID NO: 327284 - protein, 22 aa, Artificial Sequence
  Description of Artificial Sequence: Synthetic peptide
  Seed: GHRPTAEAPNTTAGQVPTTEVV (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTXEVV

SEQ ID NO: 327285 - protein, 23 aa, Artificial Sequence
  Description of Artificial Sequence: Synthetic peptide
  Seed: GHRPTAEAPNTTAGQVPTTEVVG (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTXEVVG

SEQ ID NO: 327286 - protein, 24 aa, Artificial Sequence
  Description of Artificial Sequence: Synthetic peptide
  Seed: GHRPTAEAPNTTAGQVPTTEVVGT (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTXEVVGT

SEQ ID NO: 327287 - protein, 25 aa, Artificial Sequence
  Description of Artificial Sequence: Synthetic peptide
  Seed: GHRPTAEAPNTTAGQVPTTEVVGTT (PMEL_HUMAN)
  Core: TTAGQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GHRPTAEAPNXTAXQXPTXEVVGTT

SEQ ID NO: 327288 - protein, 13 aa, Artificial Sequence
  Description of Artificial Sequence: Synthetic peptide
  Seed: GIESAEILQAVPS (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPS

SEQ ID NO: 327289 - protein, 14 aa, Artificial Sequence
  Description of Artificial Sequence: Synthetic peptide
  Seed: GIESAEILQAVPSG (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSG

SEQ ID NO: 327290 - protein, 14 aa, Artificial Sequence
  Description of Artificial Sequence: Synthetic peptide
  Seed: GIESAEILQAVPSG (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSG

SEQ ID NO: 327291 - protein, 14 aa, Artificial Sequence
  Description of Artificial Sequence: Synthetic peptide
  Seed: GIESAEILQAVPSG (PMEL_HUMAN)
  Core: AEILQAVPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GIESXEIXQXVPXG

SEQ ID NO: 327292 - protein, 15 aa, Artificial Sequence
  Description of Artificial Sequence: Synthetic peptide
  Seed: GIESAEILQAVPSGE (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGE

SEQ ID NO: 327293 - protein, 15 aa, Artificial Sequence
  Description of Artificial Sequence: Synthetic peptide
  Seed: GIESAEILQAVPSGE (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGE

SEQ ID NO: 327294 - protein, 15 aa, Artificial Sequence
  Description of Artificial Sequence: Synthetic peptide
  Seed: GIESAEILQAVPSGE (PMEL_HUMAN)
  Core: AEILQAVPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GIESXEIXQXVPXGE

SEQ ID NO: 327295 - protein, 16 aa, Artificial Sequence
  Description of Artificial Sequence: Synthetic peptide
  Seed: GIESAEILQAVPSGEG (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEG

SEQ ID NO: 327296 - protein, 16 aa, Artificial Sequence
  Description of Artificial Sequence: Synthetic peptide
  Seed: GIESAEILQAVPSGEG (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEG

SEQ ID NO: 327297 - protein, 16 aa, Artificial Sequence
  Description of Artificial Sequence: Synthetic peptide
  Seed: GIESAEILQAVPSGEG (PMEL_HUMAN)
  Core: AEILQAVPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GIESXEIXQXVPXGEG

SEQ ID NO: 327298 - protein, 16 aa, Artificial Sequence
  Description of Artificial Sequence: Synthetic peptide
  Seed: GIESAEILQAVPSGEG (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXG

SEQ ID NO: 327299 - protein, 17 aa, Artificial Sequence
  Description of Artificial Sequence: Synthetic peptide
  Seed: GIESAEILQAVPSGEGD (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGD

SEQ ID NO: 327300 - protein, 17 aa, Artificial Sequence
  Description of Artificial Sequence: Synthetic peptide
  Seed: GIESAEILQAVPSGEGD (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEGD

SEQ ID NO: 327301 - protein, 17 aa, Artificial Sequence
  Description of Artificial Sequence: Synthetic peptide
  Seed: GIESAEILQAVPSGEGD (PMEL_HUMAN)
  Core: AEILQAVPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GIESXEIXQXVPXGEGD

SEQ ID NO: 327302 - protein, 17 aa, Artificial Sequence
  Description of Artificial Sequence: Synthetic peptide
  Seed: GIESAEILQAVPSGEGD (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGD

SEQ ID NO: 327303 - protein, 18 aa, Artificial Sequence
  Description of Artificial Sequence: Synthetic peptide
  Seed: GIESAEILQAVPSGEGDA (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDA

SEQ ID NO: 327304 - protein, 18 aa, Artificial Sequence
  Description of Artificial Sequence: Synthetic peptide
  Seed: GIESAEILQAVPSGEGDA (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDA

SEQ ID NO: 327305 - protein, 19 aa, Artificial Sequence
  Description of Artificial Sequence: Synthetic peptide
  Seed: GIESAEILQAVPSGEGDAF (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAF

SEQ ID NO: 327306 - protein, 19 aa, Artificial Sequence
  Description of Artificial Sequence: Synthetic peptide
  Seed: GIESAEILQAVPSGEGDAF (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAF

SEQ ID NO: 327307 - protein, 19 aa, Artificial Sequence
  Description of Artificial Sequence: Synthetic peptide
  Seed: GIESAEILQAVPSGEGDAF (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAF

SEQ ID NO: 327308 - protein, 20 aa, Artificial Sequence
  Description of Artificial Sequence: Synthetic peptide
  Seed: GIESAEILQAVPSGEGDAFE (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAFE

SEQ ID NO: 327309 - protein, 20 aa, Artificial Sequence
  Description of Artificial Sequence: Synthetic peptide
  Seed: GIESAEILQAVPSGEGDAFE (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEGDAFE

SEQ ID NO: 327310 - protein, 20 aa, Artificial Sequence
  Description of Artificial Sequence: Synthetic peptide
  Seed: GIESAEILQAVPSGEGDAFE (PMEL_HUMAN)
  Core: AEILQAVPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GIESXEIXQXVPXGEGDAFE

SEQ ID NO: 327311 - protein, 20 aa, Artificial Sequence
  Description of Artificial Sequence: Synthetic peptide
  Seed: GIESAEILQAVPSGEGDAFE (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAFE

SEQ ID NO: 327312 - protein, 20 aa, Artificial Sequence
  Description of Artificial Sequence: Synthetic peptide
  Seed: GIESAEILQAVPSGEGDAFE (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAFE

SEQ ID NO: 327313 - protein, 21 aa, Artificial Sequence
  Description of Artificial Sequence: Synthetic peptide
  Seed: GIESAEILQAVPSGEGDAFEL (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAFEL

SEQ ID NO: 327314 - protein, 21 aa, Artificial Sequence
  Description of Artificial Sequence: Synthetic peptide
  Seed: GIESAEILQAVPSGEGDAFEL (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEGDAFEL

SEQ ID NO: 327315 - protein, 21 aa, Artificial Sequence
  Description of Artificial Sequence: Synthetic peptide
  Seed: GIESAEILQAVPSGEGDAFEL (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAFEL

SEQ ID NO: 327316 - protein, 21 aa, Artificial Sequence
  Description of Artificial Sequence: Synthetic peptide
  Seed: GIESAEILQAVPSGEGDAFEL (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAFEL

SEQ ID NO: 327317 - protein, 22 aa, Artificial Sequence
  Description of Artificial Sequence: Synthetic peptide
  Seed: GIESAEILQAVPSGEGDAFELT (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAFELT

SEQ ID NO: 327318 - protein, 22 aa, Artificial Sequence
  Description of Artificial Sequence: Synthetic peptide
  Seed: GIESAEILQAVPSGEGDAFELT (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEGDAFELT

SEQ ID NO: 327319 - protein, 22 aa, Artificial Sequence
  Description of Artificial Sequence: Synthetic peptide
  Seed: GIESAEILQAVPSGEGDAFELT (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAFELT

SEQ ID NO: 327320 - protein, 22 aa, Artificial Sequence
  Description of Artificial Sequence: Synthetic peptide
  Seed: GIESAEILQAVPSGEGDAFELT (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAFELT

SEQ ID NO: 327321 - protein, 23 aa, Artificial Sequence
  Description of Artificial Sequence: Synthetic peptide
  Seed: GIESAEILQAVPSGEGDAFELTV (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAFELTV

SEQ ID NO: 327322 - protein, 23 aa, Artificial Sequence
  Description of Artificial Sequence: Synthetic peptide
  Seed: GIESAEILQAVPSGEGDAFELTV (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEGDAFELTV

SEQ ID NO: 327323 - protein, 23 aa, Artificial Sequence
  Description of Artificial Sequence: Synthetic peptide
  Seed: GIESAEILQAVPSGEGDAFELTV (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAFELTV

SEQ ID NO: 327324 - protein, 23 aa, Artificial Sequence
  Description of Artificial Sequence: Synthetic peptide
  Seed: GIESAEILQAVPSGEGDAFELTV (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAFELTV

SEQ ID NO: 327325 - protein, 24 aa, Artificial Sequence
  Description of Artificial Sequence: Synthetic peptide
  Seed: GIESAEILQAVPSGEGDAFELTVS (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAFELTVS

SEQ ID NO: 327326 - protein, 24 aa, Artificial Sequence
  Description of Artificial Sequence: Synthetic peptide
  Seed: GIESAEILQAVPSGEGDAFELTVS (PMEL_HUMAN)
  Core: ESAEILQAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXSAXIXQAXPSGEGDAFELTVS

SEQ ID NO: 327327 - protein, 24 aa, Artificial Sequence
  Description of Artificial Sequence: Synthetic peptide
  Seed: GIESAEILQAVPSGEGDAFELTVS (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAFELTVS

SEQ ID NO: 327328 - protein, 24 aa, Artificial Sequence
  Description of Artificial Sequence: Synthetic peptide
  Seed: GIESAEILQAVPSGEGDAFELTVS (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAFELTVS

SEQ ID NO: 327329 - protein, 24 aa, Artificial Sequence
  Description of Artificial Sequence: Synthetic peptide
  Seed: GIESAEILQAVPSGEGDAFELTVS (PMEL_HUMAN)
  Core: GEGDAFELT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEILQAVPSXEGXAXELXVS

SEQ ID NO: 327330 - protein, 25 aa, Artificial Sequence
  Description of Artificial Sequence: Synthetic peptide
  Seed: GIESAEILQAVPSGEGDAFELTVSC (PMEL_HUMAN)
  Core: IESAEILQA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXESXEXLQXVPSGEGDAFELTVSC

SEQ ID NO: 327331 - protein, 25 aa, Artificial Sequence
  Description of Artificial Sequence: Synthetic peptide
  Seed: GIESAEILQAVPSGEGDAFELTVSC (PMEL_HUMAN)
  Core: ILQAVPSGE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEXLQXVXSGXGDAFELTVSC

SEQ ID NO: 327332 - protein, 25 aa, Artificial Sequence
  Description of Artificial Sequence: Synthetic peptide
  Seed: GIESAEILQAVPSGEGDAFELTVSC (PMEL_HUMAN)
  Core: LQAVPSGEG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GIESAEIXQAXPXGEXDAFELTVSC

SEQ ID NO: 327333 - protein, 14 aa, Artificial Sequence
  Description of Artificial Sequence: Synthetic peptide
  Seed: GILLVLMAVVLASL (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASL

SEQ ID NO: 327334 - protein, 14 aa, Artificial Sequence
  Description of Artificial Sequence: Synthetic peptide
  Seed: GILLVLMAVVLASL (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSL

SEQ ID NO: 327335 - protein, 15 aa, Artificial Sequence
  Description of Artificial Sequence: Synthetic peptide
  Seed: GILLVLMAVVLASLI (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLI

SEQ ID NO: 327336 - protein, 15 aa, Artificial Sequence
  Description of Artificial Sequence: Synthetic peptide
  Seed: GILLVLMAVVLASLI (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLI

SEQ ID NO: 327337 - protein, 15 aa, Artificial Sequence
  Description of Artificial Sequence: Synthetic peptide
  Seed: GILLVLMAVVLASLI (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLI

SEQ ID NO: 327338 - protein, 15 aa, Artificial Sequence
  Description of Artificial Sequence: Synthetic peptide
  Seed: GILLVLMAVVLASLI (PMEL_HUMAN)
  Core: LMAVVLASL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GILLVXMAXVXASXI

SEQ ID NO: 327339 - protein, 16 aa, Artificial Sequence
  Description of Artificial Sequence: Synthetic peptide
  Seed: GILLVLMAVVLASLIY (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIY

SEQ ID NO: 327340 - protein, 16 aa, Artificial Sequence
  Description of Artificial Sequence: Synthetic peptide
  Seed: GILLVLMAVVLASLIY (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIY

SEQ ID NO: 327341 - protein, 16 aa, Artificial Sequence
  Description of Artificial Sequence: Synthetic peptide
  Seed: GILLVLMAVVLASLIY (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIY

SEQ ID NO: 327342 - protein, 16 aa, Artificial Sequence
  Description of Artificial Sequence: Synthetic peptide
  Seed: GILLVLMAVVLASLIY (PMEL_HUMAN)
  Core: LMAVVLASL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GILLVXMAXVXASXIY

SEQ ID NO: 327343 - protein, 16 aa, Artificial Sequence
  Description of Artificial Sequence: Synthetic peptide
  Seed: GILLVLMAVVLASLIY (PMEL_HUMAN)
  Core: MAVVLASLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLXAVXLXSLXY

SEQ ID NO: 327344 - protein, 17 aa, Artificial Sequence
  Description of Artificial Sequence: Synthetic peptide
  Seed: GILLVLMAVVLASLIYR (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYR

SEQ ID NO: 327345 - protein, 17 aa, Artificial Sequence
  Description of Artificial Sequence: Synthetic peptide
  Seed: GILLVLMAVVLASLIYR (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYR

SEQ ID NO: 327346 - protein, 17 aa, Artificial Sequence
  Description of Artificial Sequence: Synthetic peptide
  Seed: GILLVLMAVVLASLIYR (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYR

SEQ ID NO: 327347 - protein, 17 aa, Artificial Sequence
  Description of Artificial Sequence: Synthetic peptide
  Seed: GILLVLMAVVLASLIYR (PMEL_HUMAN)
  Core: LMAVVLASL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GILLVXMAXVXASXIYR

SEQ ID NO: 327348 - protein, 17 aa, Artificial Sequence
  Description of Artificial Sequence: Synthetic peptide
  Seed: GILLVLMAVVLASLIYR (PMEL_HUMAN)
  Core: MAVVLASLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLXAVXLXSLXYR

SEQ ID NO: 327349 - protein, 18 aa, Artificial Sequence
  Description of Artificial Sequence: Synthetic peptide
  Seed: GILLVLMAVVLASLIYRR (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRR

SEQ ID NO: 327350 - protein, 18 aa, Artificial Sequence
  Description of Artificial Sequence: Synthetic peptide
  Seed: GILLVLMAVVLASLIYRR (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRR

SEQ ID NO: 327351 - protein, 18 aa, Artificial Sequence
  Description of Artificial Sequence: Synthetic peptide
  Seed: GILLVLMAVVLASLIYRR (PMEL_HUMAN)
  Core: LMAVVLASL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GILLVXMAXVXASXIYRR

SEQ ID NO: 327352 - protein, 18 aa, Artificial Sequence
  Description of Artificial Sequence: Synthetic peptide
  Seed: GILLVLMAVVLASLIYRR (PMEL_HUMAN)
  Core: MAVVLASLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLXAVXLXSLXYRR

SEQ ID NO: 327353 - protein, 18 aa, Artificial Sequence
  Description of Artificial Sequence: Synthetic peptide
  Seed: GILLVLMAVVLASLIYRR (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRR

SEQ ID NO: 327354 - protein, 18 aa, Artificial Sequence
  Description of Artificial Sequence: Synthetic peptide
  Seed: GILLVLMAVVLASLIYRR (PMEL_HUMAN)
  Core: VVLASLIYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAXVLXSXIYXR

SEQ ID NO: 327355 - protein, 18 aa, Artificial Sequence
  Description of Artificial Sequence: Synthetic peptide
  Seed: GILLVLMAVVLASLIYRR (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRX

SEQ ID NO: 327356 - protein, 19 aa, Artificial Sequence
  Description of Artificial Sequence: Synthetic peptide
  Seed: GILLVLMAVVLASLIYRRR (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRR

SEQ ID NO: 327357 - protein, 19 aa, Artificial Sequence
  Description of Artificial Sequence: Synthetic peptide
  Seed: GILLVLMAVVLASLIYRRR (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRR

SEQ ID NO: 327358 - protein, 19 aa, Artificial Sequence
  Description of Artificial Sequence: Synthetic peptide
  Seed: GILLVLMAVVLASLIYRRR (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRR

SEQ ID NO: 327359 - protein, 19 aa, Artificial Sequence
  Description of Artificial Sequence: Synthetic peptide
  Seed: GILLVLMAVVLASLIYRRR (PMEL_HUMAN)
  Core: MAVVLASLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLXAVXLXSLXYRRR

SEQ ID NO: 327360 - protein, 19 aa, Artificial Sequence
  Description of Artificial Sequence: Synthetic peptide
  Seed: GILLVLMAVVLASLIYRRR (PMEL_HUMAN)
  Core: VVLASLIYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAXVLXSXIYXRR

SEQ ID NO: 327361 - protein, 19 aa, Artificial Sequence
  Description of Artificial Sequence: Synthetic peptide
  Seed: GILLVLMAVVLASLIYRRR (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXR

SEQ ID NO: 327362 - protein, 19 aa, Artificial Sequence
  Description of Artificial Sequence: Synthetic peptide
  Seed: GILLVLMAVVLASLIYRRR (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRX

SEQ ID NO: 327363 - protein, 20 aa, Artificial Sequence
  Description of Artificial Sequence: Synthetic peptide
  Seed: GILLVLMAVVLASLIYRRRL (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRRL

SEQ ID NO: 327364 - protein, 20 aa, Artificial Sequence
  Description of Artificial Sequence: Synthetic peptide
  Seed: GILLVLMAVVLASLIYRRRL (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRRL

SEQ ID NO: 327365 - protein, 20 aa, Artificial Sequence
  Description of Artificial Sequence: Synthetic peptide
  Seed: GILLVLMAVVLASLIYRRRL (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRRL

SEQ ID NO: 327366 - protein, 20 aa, Artificial Sequence
  Description of Artificial Sequence: Synthetic peptide
  Seed: GILLVLMAVVLASLIYRRRL (PMEL_HUMAN)
  Core: LMAVVLASL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GILLVXMAXVXASXIYRRRL

SEQ ID NO: 327367 - protein, 20 aa, Artificial Sequence
  Description of Artificial Sequence: Synthetic peptide
  Seed: GILLVLMAVVLASLIYRRRL (PMEL_HUMAN)
  Core: MAVVLASLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLXAVXLXSLXYRRRL

SEQ ID NO: 327368 - protein, 20 aa, Artificial Sequence
  Description of Artificial Sequence: Synthetic peptide
  Seed: GILLVLMAVVLASLIYRRRL (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRRRL

SEQ ID NO: 327369 - protein, 20 aa, Artificial Sequence
  Description of Artificial Sequence: Synthetic peptide
  Seed: GILLVLMAVVLASLIYRRRL (PMEL_HUMAN)
  Core: VVLASLIYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAXVLXSXIYXRRL

SEQ ID NO: 327370 - protein, 20 aa, Artificial Sequence
  Description of Artificial Sequence: Synthetic peptide
  Seed: GILLVLMAVVLASLIYRRRL (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXRL

SEQ ID NO: 327371 - protein, 20 aa, Artificial Sequence
  Description of Artificial Sequence: Synthetic peptide
  Seed: GILLVLMAVVLASLIYRRRL (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRXL

SEQ ID NO: 327372 - protein, 21 aa, Artificial Sequence
  Description of Artificial Sequence: Synthetic peptide
  Seed: GILLVLMAVVLASLIYRRRLM (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRRLM

SEQ ID NO: 327373 - protein, 21 aa, Artificial Sequence
  Description of Artificial Sequence: Synthetic peptide
  Seed: GILLVLMAVVLASLIYRRRLM (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRRLM

SEQ ID NO: 327374 - protein, 21 aa, Artificial Sequence
  Description of Artificial Sequence: Synthetic peptide
  Seed: GILLVLMAVVLASLIYRRRLM (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRRLM

SEQ ID NO: 327375 - protein, 21 aa, Artificial Sequence
  Description of Artificial Sequence: Synthetic peptide
  Seed: GILLVLMAVVLASLIYRRRLM (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRRRLM

SEQ ID NO: 327376 - protein, 21 aa, Artificial Sequence
  Description of Artificial Sequence: Synthetic peptide
  Seed: GILLVLMAVVLASLIYRRRLM (PMEL_HUMAN)
  Core: VVLASLIYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAXVLXSXIYXRRLM

SEQ ID NO: 327377 - protein, 21 aa, Artificial Sequence
  Description of Artificial Sequence: Synthetic peptide
  Seed: GILLVLMAVVLASLIYRRRLM (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXRLM

SEQ ID NO: 327378 - protein, 21 aa, Artificial Sequence
  Description of Artificial Sequence: Synthetic peptide
  Seed: GILLVLMAVVLASLIYRRRLM (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRXLM

SEQ ID NO: 327379 - protein, 22 aa, Artificial Sequence
  Description of Artificial Sequence: Synthetic peptide
  Seed: GILLVLMAVVLASLIYRRRLMK (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRRLMK

SEQ ID NO: 327380 - protein, 22 aa, Artificial Sequence
  Description of Artificial Sequence: Synthetic peptide
  Seed: GILLVLMAVVLASLIYRRRLMK (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRRLMK

SEQ ID NO: 327381 - protein, 22 aa, Artificial Sequence
  Description of Artificial Sequence: Synthetic peptide
  Seed: GILLVLMAVVLASLIYRRRLMK (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRRLMK

SEQ ID NO: 327382 - protein, 22 aa, Artificial Sequence
  Description of Artificial Sequence: Synthetic peptide
  Seed: GILLVLMAVVLASLIYRRRLMK (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRRRLMK

SEQ ID NO: 327383 - protein, 22 aa, Artificial Sequence
  Description of Artificial Sequence: Synthetic peptide
  Seed: GILLVLMAVVLASLIYRRRLMK (PMEL_HUMAN)
  Core: VVLASLIYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAXVLXSXIYXRRLMK

SEQ ID NO: 327384 - protein, 22 aa, Artificial Sequence
  Description of Artificial Sequence: Synthetic peptide
  Seed: GILLVLMAVVLASLIYRRRLMK (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXRLMK

SEQ ID NO: 327385 - protein, 22 aa, Artificial Sequence
  Description of Artificial Sequence: Synthetic peptide
  Seed: GILLVLMAVVLASLIYRRRLMK (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRXLMK

SEQ ID NO: 327386 - protein, 22 aa, Artificial Sequence
  Description of Artificial Sequence: Synthetic peptide
  Seed: GILLVLMAVVLASLIYRRRLMK (PMEL_HUMAN)
  Core: SLIYRRRLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLAXLIXRXRLXK

SEQ ID NO: 327387 - protein, 23 aa, Artificial Sequence
  Description of Artificial Sequence: Synthetic peptide
  Seed: GILLVLMAVVLASLIYRRRLMKQ (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRRLMKQ

SEQ ID NO: 327388 - protein, 23 aa, Artificial Sequence
  Description of Artificial Sequence: Synthetic peptide
  Seed: GILLVLMAVVLASLIYRRRLMKQ (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRRLMKQ

SEQ ID NO: 327389 - protein, 23 aa, Artificial Sequence
  Description of Artificial Sequence: Synthetic peptide
  Seed: GILLVLMAVVLASLIYRRRLMKQ (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRRLMKQ

SEQ ID NO: 327390 - protein, 23 aa, Artificial Sequence
  Description of Artificial Sequence: Synthetic peptide
  Seed: GILLVLMAVVLASLIYRRRLMKQ (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRRRLMKQ

SEQ ID NO: 327391 - protein, 23 aa, Artificial Sequence
  Description of Artificial Sequence: Synthetic peptide
  Seed: GILLVLMAVVLASLIYRRRLMKQ (PMEL_HUMAN)
  Core: VVLASLIYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAXVLXSXIYXRRLMKQ

SEQ ID NO: 327392 - protein, 23 aa, Artificial Sequence
  Description of Artificial Sequence: Synthetic peptide
  Seed: GILLVLMAVVLASLIYRRRLMKQ (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXRLMKQ

SEQ ID NO: 327393 - protein, 23 aa, Artificial Sequence
  Description of Artificial Sequence: Synthetic peptide
  Seed: GILLVLMAVVLASLIYRRRLMKQ (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRXLMKQ

SEQ ID NO: 327394 - protein, 23 aa, Artificial Sequence
  Description of Artificial Sequence: Synthetic peptide
  Seed: GILLVLMAVVLASLIYRRRLMKQ (PMEL_HUMAN)
  Core: ASLIYRRRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLXSLXYXRRXMKQ

SEQ ID NO: 327395 - protein, 23 aa, Artificial Sequence
  Description of Artificial Sequence: Synthetic peptide
  Seed: GILLVLMAVVLASLIYRRRLMKQ (PMEL_HUMAN)
  Core: SLIYRRRLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLAXLIXRXRLXKQ

SEQ ID NO: 327396 - protein, 23 aa, Artificial Sequence
  Description of Artificial Sequence: Synthetic peptide
  Seed: GILLVLMAVVLASLIYRRRLMKQ (PMEL_HUMAN)
  Core: LIYRRRLMK
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLASXIYXRXLMXQ

SEQ ID NO: 327397 - protein, 24 aa, Artificial Sequence
  Description of Artificial Sequence: Synthetic peptide
  Seed: GILLVLMAVVLASLIYRRRLMKQD (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRRLMKQD

SEQ ID NO: 327398 - protein, 24 aa, Artificial Sequence
  Description of Artificial Sequence: Synthetic peptide
  Seed: GILLVLMAVVLASLIYRRRLMKQD (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRRLMKQD

SEQ ID NO: 327399 - protein, 24 aa, Artificial Sequence
  Description of Artificial Sequence: Synthetic peptide
  Seed: GILLVLMAVVLASLIYRRRLMKQD (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRRLMKQD

SEQ ID NO: 327400 - protein, 24 aa, Artificial Sequence
  Description of Artificial Sequence: Synthetic peptide
  Seed: GILLVLMAVVLASLIYRRRLMKQD (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRRRLMKQD

SEQ ID NO: 327401 - protein, 24 aa, Artificial Sequence
  Description of Artificial Sequence: Synthetic peptide
  Seed: GILLVLMAVVLASLIYRRRLMKQD (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXRLMKQD

SEQ ID NO: 327402 - protein, 24 aa, Artificial Sequence
  Description of Artificial Sequence: Synthetic peptide
  Seed: GILLVLMAVVLASLIYRRRLMKQD (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRXLMKQD

SEQ ID NO: 327403 - protein, 24 aa, Artificial Sequence
  Description of Artificial Sequence: Synthetic peptide
  Seed: GILLVLMAVVLASLIYRRRLMKQD (PMEL_HUMAN)
  Core: ASLIYRRRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLXSLXYXRRXMKQD

SEQ ID NO: 327404 - protein, 24 aa, Artificial Sequence
  Description of Artificial Sequence: Synthetic peptide
  Seed: GILLVLMAVVLASLIYRRRLMKQD (PMEL_HUMAN)
  Core: SLIYRRRLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLAXLIXRXRLXKQD

SEQ ID NO: 327405 - protein, 24 aa, Artificial Sequence
  Description of Artificial Sequence: Synthetic peptide
  Seed: GILLVLMAVVLASLIYRRRLMKQD (PMEL_HUMAN)
  Core: LIYRRRLMK
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLASXIYXRXLMXQD

SEQ ID NO: 327406 - protein, 25 aa, Artificial Sequence
  Description of Artificial Sequence: Synthetic peptide
  Seed: GILLVLMAVVLASLIYRRRLMKQDF (PMEL_HUMAN)
  Core: LLVLMAVVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GIXLVXMXVVXASLIYRRRLMKQDF

SEQ ID NO: 327407 - protein, 25 aa, Artificial Sequence
  Description of Artificial Sequence: Synthetic peptide
  Seed: GILLVLMAVVLASLIYRRRLMKQDF (PMEL_HUMAN)
  Core: LVLMAVVLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GILXVLXAXVLXSLIYRRRLMKQDF

SEQ ID NO: 327408 - protein, 25 aa, Artificial Sequence
  Description of Artificial Sequence: Synthetic peptide
  Seed: GILLVLMAVVLASLIYRRRLMKQDF (PMEL_HUMAN)
  Core: VLMAVVLAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GILLXLMXVXLAXLIYRRRLMKQDF

SEQ ID NO: 327409 - protein, 25 aa, Artificial Sequence
  Description of Artificial Sequence: Synthetic peptide
  Seed: GILLVLMAVVLASLIYRRRLMKQDF (PMEL_HUMAN)
  Core: MAVVLASLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLXAVXLXSLXYRRRLMKQDF

SEQ ID NO: 327410 - protein, 25 aa, Artificial Sequence
  Description of Artificial Sequence: Synthetic peptide
  Seed: GILLVLMAVVLASLIYRRRLMKQDF (PMEL_HUMAN)
  Core: AVVLASLIY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMXVVXAXLIXRRRLMKQDF

SEQ ID NO: 327411 - protein, 25 aa, Artificial Sequence
  Description of Artificial Sequence: Synthetic peptide
  Seed: GILLVLMAVVLASLIYRRRLMKQDF (PMEL_HUMAN)
  Core: VLASLIYRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVXLAXLXYRXRLMKQDF

SEQ ID NO: 327412 - protein, 25 aa, Artificial Sequence
  Description of Artificial Sequence: Synthetic peptide
  Seed: GILLVLMAVVLASLIYRRRLMKQDF (PMEL_HUMAN)
  Core: LASLIYRRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVXASXIXRRXLMKQDF

SEQ ID NO: 327413 - protein, 25 aa, Artificial Sequence
  Description of Artificial Sequence: Synthetic peptide
  Seed: GILLVLMAVVLASLIYRRRLMKQDF (PMEL_HUMAN)
  Core: ASLIYRRRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLXSLXYXRRXMKQDF

SEQ ID NO: 327414 - protein, 25 aa, Artificial Sequence
  Description of Artificial Sequence: Synthetic peptide
  Seed: GILLVLMAVVLASLIYRRRLMKQDF (PMEL_HUMAN)
  Core: SLIYRRRLM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLAXLIXRXRLXKQDF

SEQ ID NO: 327415 - protein, 25 aa, Artificial Sequence
  Description of Artificial Sequence: Synthetic peptide
  Seed: GILLVLMAVVLASLIYRRRLMKQDF (PMEL_HUMAN)
  Core: LIYRRRLMK
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLASXIYXRXLMXQDF

SEQ ID NO: 327416 - protein, 25 aa, Artificial Sequence
  Description of Artificial Sequence: Synthetic peptide
  Seed: GILLVLMAVVLASLIYRRRLMKQDF (PMEL_HUMAN)
  Core: IYRRRLMKQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLASLXYRXRXMKXDF

SEQ ID NO: 327417 - protein, 25 aa, Artificial Sequence
  Description of Artificial Sequence: Synthetic peptide
  Seed: GILLVLMAVVLASLIYRRRLMKQDF (PMEL_HUMAN)
  Core: YRRRLMKQD
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GILLVLMAVVLASLIXRRXLXKQXF

SEQ ID NO: 327418 - protein, 14 aa, Artificial Sequence
  Description of Artificial Sequence: Synthetic peptide
  Seed: GLGQVPLIVGILLV (PMEL_HUMAN)
  Core: QVPLIVGIL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLGXVPXIXGIXLV

SEQ ID NO: 327419 - protein, 15 aa, Artificial Sequence
  Description of Artificial Sequence: Synthetic peptide
  Seed: GLGQVPLIVGILLVL (PMEL_HUMAN)
  Core: QVPLIVGIL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLGXVPXIXGIXLVL

SEQ ID NO: 327420 - protein, 15 aa, Artificial Sequence
  Description of Artificial Sequence: Synthetic peptide
  Seed: GLGQVPLIVGILLVL (PMEL_HUMAN)
  Core: PLIVGILLV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVXLIXGXLLXL

SEQ ID NO: 327421 - protein, 15 aa, Artificial Sequence
  Description of Artificial Sequence: Synthetic peptide
  Seed: GLGQVPLIVGILLVL (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVX

SEQ ID NO: 327422 - protein, 16 aa, Artificial Sequence
  Description of Artificial Sequence: Synthetic peptide
  Seed: GLGQVPLIVGILLVLM (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVXM

SEQ ID NO: 327423 - protein, 16 aa, Artificial Sequence
  Description of Artificial Sequence: Synthetic peptide
  Seed: GLGQVPLIVGILLVLM (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLX

SEQ ID NO: 327424 - protein, 17 aa, Artificial Sequence
  Description of Artificial Sequence: Synthetic peptide
  Seed: GLGQVPLIVGILLVLMA (PMEL_HUMAN)
  Core: QVPLIVGIL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLGXVPXIXGIXLVLMA

SEQ ID NO: 327425 - protein, 17 aa, Artificial Sequence
  Description of Artificial Sequence: Synthetic peptide
  Seed: GLGQVPLIVGILLVLMA (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVXMA

SEQ ID NO: 327426 - protein, 17 aa, Artificial Sequence
  Description of Artificial Sequence: Synthetic peptide
  Seed: GLGQVPLIVGILLVLMA (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXA

SEQ ID NO: 327427 - protein, 17 aa, Artificial Sequence
  Description of Artificial Sequence: Synthetic peptide
  Seed: GLGQVPLIVGILLVLMA (PMEL_HUMAN)
  Core: VGILLVLMA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIXGIXLXLMX

SEQ ID NO: 327428 - protein, 18 aa, Artificial Sequence
  Description of Artificial Sequence: Synthetic peptide
  Seed: GLGQVPLIVGILLVLMAV (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVXMAV

SEQ ID NO: 327429 - protein, 18 aa, Artificial Sequence
  Description of Artificial Sequence: Synthetic peptide
  Seed: GLGQVPLIVGILLVLMAV (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAV

SEQ ID NO: 327430 - protein, 19 aa, Artificial Sequence
  Description of Artificial Sequence: Synthetic peptide
  Seed: GLGQVPLIVGILLVLMAVV (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVXMAVV

SEQ ID NO: 327431 - protein, 19 aa, Artificial Sequence
  Description of Artificial Sequence: Synthetic peptide
  Seed: GLGQVPLIVGILLVLMAVV (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVV

SEQ ID NO: 327432 - protein, 20 aa, Artificial Sequence
  Description of Artificial Sequence: Synthetic peptide
  Seed: GLGQVPLIVGILLVLMAVVL (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVXMAVVL

SEQ ID NO: 327433 - protein, 20 aa, Artificial Sequence
  Description of Artificial Sequence: Synthetic peptide
  Seed: GLGQVPLIVGILLVLMAVVL (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVVL

SEQ ID NO: 327434 - protein, 21 aa, Artificial Sequence
  Description of Artificial Sequence: Synthetic peptide
  Seed: GLGQVPLIVGILLVLMAVVLA (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVVLA

SEQ ID NO: 327435 - protein, 21 aa, Artificial Sequence
  Description of Artificial Sequence: Synthetic peptide
  Seed: GLGQVPLIVGILLVLMAVVLA (PMEL_HUMAN)
  Core: ILLVLMAVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGXLLXLXAVXLA

SEQ ID NO: 327436 - protein, 21 aa, Artificial Sequence
  Description of Artificial Sequence: Synthetic peptide
  Seed: GLGQVPLIVGILLVLMAVVLA (PMEL_HUMAN)
  Core: LLVLMAVVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGIXLVXMXVVXA

SEQ ID NO: 327437 - protein, 22 aa, Artificial Sequence
  Description of Artificial Sequence: Synthetic peptide
  Seed: GLGQVPLIVGILLVLMAVVLAS (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVVLAS

SEQ ID NO: 327438 - protein, 22 aa, Artificial Sequence
  Description of Artificial Sequence: Synthetic peptide
  Seed: GLGQVPLIVGILLVLMAVVLAS (PMEL_HUMAN)
  Core: ILLVLMAVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGXLLXLXAVXLAS

SEQ ID NO: 327439 - protein, 22 aa, Artificial Sequence
  Description of Artificial Sequence: Synthetic peptide
  Seed: GLGQVPLIVGILLVLMAVVLAS (PMEL_HUMAN)
  Core: LLVLMAVVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGIXLVXMXVVXAS

SEQ ID NO: 327440 - protein, 22 aa, Artificial Sequence
  Description of Artificial Sequence: Synthetic peptide
  Seed: GLGQVPLIVGILLVLMAVVLAS (PMEL_HUMAN)
  Core: LVLMAVVLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGILXVLXAXVLXS

SEQ ID NO: 327441 - protein, 23 aa, Artificial Sequence
  Description of Artificial Sequence: Synthetic peptide
  Seed: GLGQVPLIVGILLVLMAVVLASL (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVVLASL

SEQ ID NO: 327442 - protein, 23 aa, Artificial Sequence
  Description of Artificial Sequence: Synthetic peptide
  Seed: GLGQVPLIVGILLVLMAVVLASL (PMEL_HUMAN)
  Core: ILLVLMAVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGXLLXLXAVXLASL

SEQ ID NO: 327443 - protein, 23 aa, Artificial Sequence
  Description of Artificial Sequence: Synthetic peptide
  Seed: GLGQVPLIVGILLVLMAVVLASL (PMEL_HUMAN)
  Core: LLVLMAVVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGIXLVXMXVVXASL

SEQ ID NO: 327444 - protein, 23 aa, Artificial Sequence
  Description of Artificial Sequence: Synthetic peptide
  Seed: GLGQVPLIVGILLVLMAVVLASL (PMEL_HUMAN)
  Core: LVLMAVVLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGILXVLXAXVLXSL

SEQ ID NO: 327445 - protein, 24 aa, Artificial Sequence
  Description of Artificial Sequence: Synthetic peptide
  Seed: GLGQVPLIVGILLVLMAVVLASLI (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVVLASLI

SEQ ID NO: 327446 - protein, 24 aa, Artificial Sequence
  Description of Artificial Sequence: Synthetic peptide
  Seed: GLGQVPLIVGILLVLMAVVLASLI (PMEL_HUMAN)
  Core: ILLVLMAVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGXLLXLXAVXLASLI

SEQ ID NO: 327447 - protein, 24 aa, Artificial Sequence
  Description of Artificial Sequence: Synthetic peptide
  Seed: GLGQVPLIVGILLVLMAVVLASLI (PMEL_HUMAN)
  Core: LLVLMAVVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGIXLVXMXVVXASLI

SEQ ID NO: 327448 - protein, 24 aa, Artificial Sequence
  Description of Artificial Sequence: Synthetic peptide
  Seed: GLGQVPLIVGILLVLMAVVLASLI (PMEL_HUMAN)
  Core: LVLMAVVLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGILXVLXAXVLXSLI

SEQ ID NO: 327449 - protein, 25 aa, Artificial Sequence
  Description of Artificial Sequence: Synthetic peptide
  Seed: GLGQVPLIVGILLVLMAVVLASLIY (PMEL_HUMAN)
  Core: LIVGILLVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPXIVXIXLVXMAVVLASLIY

SEQ ID NO: 327450 - protein, 25 aa, Artificial Sequence
  Description of Artificial Sequence: Synthetic peptide
  Seed: GLGQVPLIVGILLVLMAVVLASLIY (PMEL_HUMAN)
  Core: IVGILLVLM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLXVGXLXVLXAVVLASLIY

SEQ ID NO: 327451 - protein, 25 aa, Artificial Sequence
  Description of Artificial Sequence: Synthetic peptide
  Seed: GLGQVPLIVGILLVLMAVVLASLIY (PMEL_HUMAN)
  Core: ILLVLMAVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGXLLXLXAVXLASLIY

SEQ ID NO: 327452 - protein, 25 aa, Artificial Sequence
  Description of Artificial Sequence: Synthetic peptide
  Seed: GLGQVPLIVGILLVLMAVVLASLIY (PMEL_HUMAN)
  Core: LLVLMAVVL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGIXLVXMXVVXASLIY

SEQ ID NO: 327453 - protein, 25 aa, Artificial Sequence
  Description of Artificial Sequence: Synthetic peptide
  Seed: GLGQVPLIVGILLVLMAVVLASLIY (PMEL_HUMAN)
  Core: VLMAVVLAS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GLGQVPLIVGILLXLMXVXLAXLIY

SEQ ID NO: 327454 - protein, 13 aa, Artificial Sequence
  Description of Artificial Sequence: Synthetic peptide
  Seed: GLSIGTGRAMLGT (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXT

SEQ ID NO: 327455 - protein, 14 aa, Artificial Sequence
  Description of Artificial Sequence: Synthetic peptide
  Seed: GLSIGTGRAMLGTH (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTH

SEQ ID NO: 327456 - protein, 15 aa, Artificial Sequence
  Description of Artificial Sequence: Synthetic peptide
  Seed: GLSIGTGRAMLGTHT (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHT

SEQ ID NO: 327457 - protein, 16 aa, Artificial Sequence
  Description of Artificial Sequence: Synthetic peptide
  Seed: GLSIGTGRAMLGTHTM (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTM

SEQ ID NO: 327458 - protein, 17 aa, Artificial Sequence
  Description of Artificial Sequence: Synthetic peptide
  Seed: GLSIGTGRAMLGTHTME (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTME

SEQ ID NO: 327459 - protein, 18 aa, Artificial Sequence
  Description of Artificial Sequence: Synthetic peptide
  Seed: GLSIGTGRAMLGTHTMEV (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEV

SEQ ID NO: 327460 - protein, 19 aa, Artificial Sequence
  Description of Artificial Sequence: Synthetic peptide
  Seed: GLSIGTGRAMLGTHTMEVT (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVT

SEQ ID NO: 327461 - protein, 19 aa, Artificial Sequence
  Description of Artificial Sequence: Synthetic peptide
  Seed: GLSIGTGRAMLGTHTMEVT (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVT

SEQ ID NO: 327462 - protein, 19 aa, Artificial Sequence
  Description of Artificial Sequence: Synthetic peptide
  Seed: GLSIGTGRAMLGTHTMEVT (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXT

SEQ ID NO: 327463 - protein, 20 aa, Artificial Sequence
  Description of Artificial Sequence: Synthetic peptide
  Seed: GLSIGTGRAMLGTHTMEVTV (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVTV

SEQ ID NO: 327464 - protein, 20 aa, Artificial Sequence
  Description of Artificial Sequence: Synthetic peptide
  Seed: GLSIGTGRAMLGTHTMEVTV (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVTV

SEQ ID NO: 327465 - protein, 20 aa, Artificial Sequence
  Description of Artificial Sequence: Synthetic peptide
  Seed: GLSIGTGRAMLGTHTMEVTV (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXTV

SEQ ID NO: 327466 - protein, 21 aa, Artificial Sequence
  Description of Artificial Sequence: Synthetic peptide
  Seed: GLSIGTGRAMLGTHTMEVTVY (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVTVY

SEQ ID NO: 327467 - protein, 21 aa, Artificial Sequence
  Description of Artificial Sequence: Synthetic peptide
  Seed: GLSIGTGRAMLGTHTMEVTVY (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVTVY

SEQ ID NO: 327468 - protein, 21 aa, Artificial Sequence
  Description of Artificial Sequence: Synthetic peptide
  Seed: GLSIGTGRAMLGTHTMEVTVY (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXTVY

SEQ ID NO: 327469 - protein, 22 aa, Artificial Sequence
  Description of Artificial Sequence: Synthetic peptide
  Seed: GLSIGTGRAMLGTHTMEVTVYH (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVTVYH

SEQ ID NO: 327470 - protein, 22 aa, Artificial Sequence
  Description of Artificial Sequence: Synthetic peptide
  Seed: GLSIGTGRAMLGTHTMEVTVYH (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVTVYH

SEQ ID NO: 327471 - protein, 22 aa, Artificial Sequence
  Description of Artificial Sequence: Synthetic peptide
  Seed: GLSIGTGRAMLGTHTMEVTVYH (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXTVYH

SEQ ID NO: 327472 - protein, 22 aa, Artificial Sequence
  Description of Artificial Sequence: Synthetic peptide
  Seed: GLSIGTGRAMLGTHTMEVTVYH (PMEL_HUMAN)
  Core: LGTHTMEVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMXGTXTXEVXVYH

SEQ ID NO: 327473 - protein, 23 aa, Artificial Sequence
  Description of Artificial Sequence: Synthetic peptide
  Seed: GLSIGTGRAMLGTHTMEVTVYHR (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVTVYHR

SEQ ID NO: 327474 - protein, 23 aa, Artificial Sequence
  Description of Artificial Sequence: Synthetic peptide
  Seed: GLSIGTGRAMLGTHTMEVTVYHR (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVTVYHR

SEQ ID NO: 327475 - protein, 23 aa, Artificial Sequence
  Description of Artificial Sequence: Synthetic peptide
  Seed: GLSIGTGRAMLGTHTMEVTVYHR (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXTVYHR

SEQ ID NO: 327476 - protein, 23 aa, Artificial Sequence
  Description of Artificial Sequence: Synthetic peptide
  Seed: GLSIGTGRAMLGTHTMEVTVYHR (PMEL_HUMAN)
  Core: LGTHTMEVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMXGTXTXEVXVYHR

SEQ ID NO: 327477 - protein, 24 aa, Artificial Sequence
  Description of Artificial Sequence: Synthetic peptide
  Seed: GLSIGTGRAMLGTHTMEVTVYHRR (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVTVYHRR

SEQ ID NO: 327478 - protein, 24 aa, Artificial Sequence
  Description of Artificial Sequence: Synthetic peptide
  Seed: GLSIGTGRAMLGTHTMEVTVYHRR (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVTVYHRR

SEQ ID NO: 327479 - protein, 24 aa, Artificial Sequence
  Description of Artificial Sequence: Synthetic peptide
  Seed: GLSIGTGRAMLGTHTMEVTVYHRR (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXTVYHRR

SEQ ID NO: 327480 - protein, 24 aa, Artificial Sequence
  Description of Artificial Sequence: Synthetic peptide
  Seed: GLSIGTGRAMLGTHTMEVTVYHRR (PMEL_HUMAN)
  Core: LGTHTMEVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMXGTXTXEVXVYHRR

SEQ ID NO: 327481 - protein, 24 aa, Artificial Sequence
  Description of Artificial Sequence: Synthetic peptide
  Seed: GLSIGTGRAMLGTHTMEVTVYHRR (PMEL_HUMAN)
  Core: THTMEVTVY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMLGXHTXEXTVXHRR

SEQ ID NO: 327482 - protein, 24 aa, Artificial Sequence
  Description of Artificial Sequence: Synthetic peptide
  Seed: GLSIGTGRAMLGTHTMEVTVYHRR (PMEL_HUMAN)
  Core: MEVTVYHRR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMLGTHTXEVXVXHRX

SEQ ID NO: 327483 - protein, 25 aa, Artificial Sequence
  Description of Artificial Sequence: Synthetic peptide
  Seed: GLSIGTGRAMLGTHTMEVTVYHRRG (PMEL_HUMAN)
  Core: IGTGRAMLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GLSXGTXRXMLXTHTMEVTVYHRRG

SEQ ID NO: 327484 - protein, 25 aa, Artificial Sequence
  Description of Artificial Sequence: Synthetic peptide
  Seed: GLSIGTGRAMLGTHTMEVTVYHRRG (PMEL_HUMAN)
  Core: RAMLGTHTM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGXAMXGXHTXEVTVYHRRG

SEQ ID NO: 327485 - protein, 25 aa, Artificial Sequence
  Description of Artificial Sequence: Synthetic peptide
  Seed: GLSIGTGRAMLGTHTMEVTVYHRRG (PMEL_HUMAN)
  Core: MLGTHTMEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAXLGXHXMEXTVYHRRG

SEQ ID NO: 327486 - protein, 25 aa, Artificial Sequence
  Description of Artificial Sequence: Synthetic peptide
  Seed: GLSIGTGRAMLGTHTMEVTVYHRRG (PMEL_HUMAN)
  Core: LGTHTMEVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMXGTXTXEVXVYHRRG

SEQ ID NO: 327487 - protein, 25 aa, Artificial Sequence
  Description of Artificial Sequence: Synthetic peptide
  Seed: GLSIGTGRAMLGTHTMEVTVYHRRG (PMEL_HUMAN)
  Core: THTMEVTVY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMLGXHTXEXTVXHRRG

SEQ ID NO: 327488 - protein, 25 aa, Artificial Sequence
  Description of Artificial Sequence: Synthetic peptide
  Seed: GLSIGTGRAMLGTHTMEVTVYHRRG (PMEL_HUMAN)
  Core: MEVTVYHRR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GLSIGTGRAMLGTHTXEVXVXHRXG

SEQ ID NO: 327489 - protein, 13 aa, Artificial Sequence
  Description of Artificial Sequence: Synthetic peptide
  Seed: GMTPAEVSIVVLS (PMEL_HUMAN)
  Core: MTPAEVSIV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXEXSIXVLS

SEQ ID NO: 327490 - protein, 14 aa, Artificial Sequence
  Description of Artificial Sequence: Synthetic peptide
  Seed: GMTPAEVSIVVLSG (PMEL_HUMAN)
  Core: MTPAEVSIV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXEXSIXVLSG

SEQ ID NO: 327491 - protein, 14 aa, Artificial Sequence
  Description of Artificial Sequence: Synthetic peptide
  Seed: GMTPAEVSIVVLSG (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSX

SEQ ID NO: 327492 - protein, 15 aa, Artificial Sequence
  Description of Artificial Sequence: Synthetic peptide
  Seed: GMTPAEVSIVVLSGT (PMEL_HUMAN)
  Core: MTPAEVSIV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXEXSIXVLSGT

SEQ ID NO: 327493 - protein, 15 aa, Artificial Sequence
  Description of Artificial Sequence: Synthetic peptide
  Seed: GMTPAEVSIVVLSGT (PMEL_HUMAN)
  Core: AEVSIVVLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GMTPXEVXIXVLXGT

SEQ ID NO: 327494 - protein, 15 aa, Artificial Sequence
  Description of Artificial Sequence: Synthetic peptide
  Seed: GMTPAEVSIVVLSGT (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXT

SEQ ID NO: 327495 - protein, 16 aa, Artificial Sequence
  Description of Artificial Sequence: Synthetic peptide
  Seed: GMTPAEVSIVVLSGTT (PMEL_HUMAN)
  Core: MTPAEVSIV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXEXSIXVLSGTT

SEQ ID NO: 327496 - protein, 16 aa, Artificial Sequence
  Description of Artificial Sequence: Synthetic peptide
  Seed: GMTPAEVSIVVLSGTT (PMEL_HUMAN)
  Core: AEVSIVVLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GMTPXEVXIXVLXGTT

SEQ ID NO: 327497 - protein, 16 aa, Artificial Sequence
  Description of Artificial Sequence: Synthetic peptide
  Seed: GMTPAEVSIVVLSGTT (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTT

SEQ ID NO: 327498 - protein, 17 aa, Artificial Sequence
  Description of Artificial Sequence: Synthetic peptide
  Seed: GMTPAEVSIVVLSGTTA (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTA

SEQ ID NO: 327499 - protein, 17 aa, Artificial Sequence
  Description of Artificial Sequence: Synthetic peptide
  Seed: GMTPAEVSIVVLSGTTA (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTX

SEQ ID NO: 327500 - protein, 18 aa, Artificial Sequence
  Description of Artificial Sequence: Synthetic peptide
  Seed: GMTPAEVSIVVLSGTTAA (PMEL_HUMAN)
  Core: MTPAEVSIV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXEXSIXVLSGTTAA

SEQ ID NO: 327501 - protein, 18 aa, Artificial Sequence
  Description of Artificial Sequence: Synthetic peptide
  Seed: GMTPAEVSIVVLSGTTAA (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTAA

SEQ ID NO: 327502 - protein, 18 aa, Artificial Sequence
  Description of Artificial Sequence: Synthetic peptide
  Seed: GMTPAEVSIVVLSGTTAA (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXA

SEQ ID NO: 327503 - protein, 19 aa, Artificial Sequence
  Description of Artificial Sequence: Synthetic peptide
  Seed: GMTPAEVSIVVLSGTTAAQ (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTAAQ

SEQ ID NO: 327504 - protein, 19 aa, Artificial Sequence
  Description of Artificial Sequence: Synthetic peptide
  Seed: GMTPAEVSIVVLSGTTAAQ (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQ

SEQ ID NO: 327505 - protein, 19 aa, Artificial Sequence
  Description of Artificial Sequence: Synthetic peptide
  Seed: GMTPAEVSIVVLSGTTAAQ (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAX

SEQ ID NO: 327506 - protein, 20 aa, Artificial Sequence
  Description of Artificial Sequence: Synthetic peptide
  Seed: GMTPAEVSIVVLSGTTAAQV (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTAAQV

SEQ ID NO: 327507 - protein, 20 aa, Artificial Sequence
  Description of Artificial Sequence: Synthetic peptide
  Seed: GMTPAEVSIVVLSGTTAAQV (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQV

SEQ ID NO: 327508 - protein, 20 aa, Artificial Sequence
  Description of Artificial Sequence: Synthetic peptide
  Seed: GMTPAEVSIVVLSGTTAAQV (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAXV

SEQ ID NO: 327509 - protein, 20 aa, Artificial Sequence
  Description of Artificial Sequence: Synthetic peptide
  Seed: GMTPAEVSIVVLSGTTAAQV (PMEL_HUMAN)
  Core: LSGTTAAQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVXSGXTXAQX

SEQ ID NO: 327510 - protein, 21 aa, Artificial Sequence
  Description of Artificial Sequence: Synthetic peptide
  Seed: GMTPAEVSIVVLSGTTAAQVT (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTAAQVT

SEQ ID NO: 327511 - protein, 21 aa, Artificial Sequence
  Description of Artificial Sequence: Synthetic peptide
  Seed: GMTPAEVSIVVLSGTTAAQVT (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQVT

SEQ ID NO: 327512 - protein, 21 aa, Artificial Sequence
  Description of Artificial Sequence: Synthetic peptide
  Seed: GMTPAEVSIVVLSGTTAAQVT (PMEL_HUMAN)
  Core: VVLSGTTAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIXVLXGXTAXQVT

SEQ ID NO: 327513 - protein, 21 aa, Artificial Sequence
  Description of Artificial Sequence: Synthetic peptide
  Seed: GMTPAEVSIVVLSGTTAAQVT (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAXVT

SEQ ID NO: 327514 - protein, 21 aa, Artificial Sequence
  Description of Artificial Sequence: Synthetic peptide
  Seed: GMTPAEVSIVVLSGTTAAQVT (PMEL_HUMAN)
  Core: LSGTTAAQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVXSGXTXAQXT

SEQ ID NO: 327515 - protein, 22 aa, Artificial Sequence
  Description of Artificial Sequence: Synthetic peptide
  Seed: GMTPAEVSIVVLSGTTAAQVTT (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTAAQVTT

SEQ ID NO: 327516 - protein, 22 aa, Artificial Sequence
  Description of Artificial Sequence: Synthetic peptide
  Seed: GMTPAEVSIVVLSGTTAAQVTT (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQVTT

SEQ ID NO: 327517 - protein, 22 aa, Artificial Sequence
  Description of Artificial Sequence: Synthetic peptide
  Seed: GMTPAEVSIVVLSGTTAAQVTT (PMEL_HUMAN)
  Core: VVLSGTTAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIXVLXGXTAXQVTT

SEQ ID NO: 327518 - protein, 22 aa, Artificial Sequence
  Description of Artificial Sequence: Synthetic peptide
  Seed: GMTPAEVSIVVLSGTTAAQVTT (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAXVTT

SEQ ID NO: 327519 - protein, 22 aa, Artificial Sequence
  Description of Artificial Sequence: Synthetic peptide
  Seed: GMTPAEVSIVVLSGTTAAQVTT (PMEL_HUMAN)
  Core: LSGTTAAQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVXSGXTXAQXTT

SEQ ID NO: 327520 - protein, 23 aa, Artificial Sequence
  Description of Artificial Sequence: Synthetic peptide
  Seed: GMTPAEVSIVVLSGTTAAQVTTT (PMEL_HUMAN)
  Core: EVSIVVLSG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAXVSXVXLSXTTAAQVTTT

SEQ ID NO: 327521 - protein, 23 aa, Artificial Sequence
  Description of Artificial Sequence: Synthetic peptide
  Seed: GMTPAEVSIVVLSGTTAAQVTTT (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQVTTT

SEQ ID NO: 327522 - protein, 23 aa, Artificial Sequence
  Description of Artificial Sequence: Synthetic peptide
  Seed: GMTPAEVSIVVLSGTTAAQVTTT (PMEL_HUMAN)
  Core: VVLSGTTAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIXVLXGXTAXQVTTT

SEQ ID NO: 327523 - protein, 23 aa, Artificial Sequence
  Description of Artificial Sequence: Synthetic peptide
  Seed: GMTPAEVSIVVLSGTTAAQVTTT (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAXVTTT

SEQ ID NO: 327524 - protein, 23 aa, Artificial Sequence
  Description of Artificial Sequence: Synthetic peptide
  Seed: GMTPAEVSIVVLSGTTAAQVTTT (PMEL_HUMAN)
  Core: LSGTTAAQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVXSGXTXAQXTTT

SEQ ID NO: 327525 - protein, 24 aa, Artificial Sequence
  Description of Artificial Sequence: Synthetic peptide
  Seed: GMTPAEVSIVVLSGTTAAQVTTTE (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQVTTTE

SEQ ID NO: 327526 - protein, 24 aa, Artificial Sequence
  Description of Artificial Sequence: Synthetic peptide
  Seed: GMTPAEVSIVVLSGTTAAQVTTTE (PMEL_HUMAN)
  Core: VVLSGTTAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIXVLXGXTAXQVTTTE

SEQ ID NO: 327527 - protein, 24 aa, Artificial Sequence
  Description of Artificial Sequence: Synthetic peptide
  Seed: GMTPAEVSIVVLSGTTAAQVTTTE (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAXVTTTE

SEQ ID NO: 327528 - protein, 24 aa, Artificial Sequence
  Description of Artificial Sequence: Synthetic peptide
  Seed: GMTPAEVSIVVLSGTTAAQVTTTE (PMEL_HUMAN)
  Core: LSGTTAAQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVXSGXTXAQXTTTE

SEQ ID NO: 327529 - protein, 25 aa, Artificial Sequence
  Description of Artificial Sequence: Synthetic peptide
  Seed: GMTPAEVSIVVLSGTTAAQVTTTEW (PMEL_HUMAN)
  Core: IVVLSGTTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSXVVXSXTTXAQVTTTEW

SEQ ID NO: 327530 - protein, 25 aa, Artificial Sequence
  Description of Artificial Sequence: Synthetic peptide
  Seed: GMTPAEVSIVVLSGTTAAQVTTTEW (PMEL_HUMAN)
  Core: VVLSGTTAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIXVLXGXTAXQVTTTEW

SEQ ID NO: 327531 - protein, 25 aa, Artificial Sequence
  Description of Artificial Sequence: Synthetic peptide
  Seed: GMTPAEVSIVVLSGTTAAQVTTTEW (PMEL_HUMAN)
  Core: VLSGTTAAQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVXLSXTXAAXVTTTEW

SEQ ID NO: 327532 - protein, 25 aa, Artificial Sequence
  Description of Artificial Sequence: Synthetic peptide
  Seed: GMTPAEVSIVVLSGTTAAQVTTTEW (PMEL_HUMAN)
  Core: LSGTTAAQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVXSGXTXAQXTTTEW

SEQ ID NO: 327533 - protein, 25 aa, Artificial Sequence
  Description of Artificial Sequence: Synthetic peptide
  Seed: GMTPAEVSIVVLSGTTAAQVTTTEW (PMEL_HUMAN)
  Core: TTAAQVTTT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GMTPAEVSIVVLSGXTAXQXTTXEW

SEQ ID NO: 327534 - protein, 20 aa, Artificial Sequence
  Description of Artificial Sequence: Synthetic peptide
  Seed: GMTPEKVPVSEVMGTTLAEM (PMEL_HUMAN)
  Core: PEKVPVSEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GMTXEKXPXSEXMGTTLAEM

SEQ ID NO: 327535 - protein, 20 aa, Artificial Sequence
  Description of Artificial Sequence: Synthetic peptide
  Seed: GMTPEKVPVSEVMGTTLAEM (PMEL_HUMAN)
  Core: VPVSEVMGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKXPVXEXMGXTLAEM

SEQ ID NO: 327536 - protein, 20 aa, Artificial Sequence
  Description of Artificial Sequence: Synthetic peptide
  Seed: GMTPEKVPVSEVMGTTLAEM (PMEL_HUMAN)
  Core: VSEVMGTTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPXSEXMXTTXAEM

SEQ ID NO: 327537 - protein, 20 aa, Artificial Sequence
  Description of Artificial Sequence: Synthetic peptide
  Seed: GMTPEKVPVSEVMGTTLAEM (PMEL_HUMAN)
  Core: VMGTTLAEM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEXMGXTXAEX

SEQ ID NO: 327538 - protein, 21 aa, Artificial Sequence
  Description of Artificial Sequence: Synthetic peptide
  Seed: GMTPEKVPVSEVMGTTLAEMS (PMEL_HUMAN)
  Core: VSEVMGTTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPXSEXMXTTXAEMS

SEQ ID NO: 327539 - protein, 21 aa, Artificial Sequence
  Description of Artificial Sequence: Synthetic peptide
  Seed: GMTPEKVPVSEVMGTTLAEMS (PMEL_HUMAN)
  Core: VMGTTLAEM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEXMGXTXAEXS

SEQ ID NO: 327540 - protein, 22 aa, Artificial Sequence
  Description of Artificial Sequence: Synthetic peptide
  Seed: GMTPEKVPVSEVMGTTLAEMST (PMEL_HUMAN)
  Core: VMGTTLAEM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEXMGXTXAEXST

SEQ ID NO: 327541 - protein, 22 aa, Artificial Sequence
  Description of Artificial Sequence: Synthetic peptide
  Seed: GMTPEKVPVSEVMGTTLAEMST (PMEL_HUMAN)
  Core: MGTTLAEMS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEVXGTXLXEMXT

SEQ ID NO: 327542 - protein, 23 aa, Artificial Sequence
  Description of Artificial Sequence: Synthetic peptide
  Seed: GMTPEKVPVSEVMGTTLAEMSTP (PMEL_HUMAN)
  Core: VMGTTLAEM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEXMGXTXAEXSTP

SEQ ID NO: 327543 - protein, 23 aa, Artificial Sequence
  Description of Artificial Sequence: Synthetic peptide
  Seed: GMTPEKVPVSEVMGTTLAEMSTP (PMEL_HUMAN)
  Core: MGTTLAEMS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEVXGTXLXEMXTP

SEQ ID NO: 327544 - protein, 24 aa, Artificial Sequence
  Description of Artificial Sequence: Synthetic peptide
  Seed: GMTPEKVPVSEVMGTTLAEMSTPE (PMEL_HUMAN)
  Core: VMGTTLAEM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEXMGXTXAEXSTPE

SEQ ID NO: 327545 - protein, 24 aa, Artificial Sequence
  Description of Artificial Sequence: Synthetic peptide
  Seed: GMTPEKVPVSEVMGTTLAEMSTPE (PMEL_HUMAN)
  Core: MGTTLAEMS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEVXGTXLXEMXTPE

SEQ ID NO: 327546 - protein, 25 aa, Artificial Sequence
  Description of Artificial Sequence: Synthetic peptide
  Seed: GMTPEKVPVSEVMGTTLAEMSTPEA (PMEL_HUMAN)
  Core: VMGTTLAEM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEXMGXTXAEXSTPEA

SEQ ID NO: 327547 - protein, 25 aa, Artificial Sequence
  Description of Artificial Sequence: Synthetic peptide
  Seed: GMTPEKVPVSEVMGTTLAEMSTPEA (PMEL_HUMAN)
  Core: MGTTLAEMS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GMTPEKVPVSEVXGTXLXEMXTPEA

SEQ ID NO: 327548 - protein, 13 aa, Artificial Sequence
  Description of Artificial Sequence: Synthetic peptide
  Seed: GNKHFLRNQPLTF (PMEL_HUMAN)
  Core: KHFLRNQPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GNXHFXRXQPXTF

SEQ ID NO: 327549 - protein, 13 aa, Artificial Sequence
  Description of Artificial Sequence: Synthetic peptide
  Seed: GNKHFLRNQPLTF (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTX

SEQ ID NO: 327550 - protein, 14 aa, Artificial Sequence
  Description of Artificial Sequence: Synthetic peptide
  Seed: GNKHFLRNQPLTFA (PMEL_HUMAN)
  Core: KHFLRNQPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GNXHFXRXQPXTFA

SEQ ID NO: 327551 - protein, 14 aa, Artificial Sequence
  Description of Artificial Sequence: Synthetic peptide
  Seed: GNKHFLRNQPLTFA (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXA

SEQ ID NO: 327552 - protein, 14 aa, Artificial Sequence
  Description of Artificial Sequence: Synthetic peptide
  Seed: GNKHFLRNQPLTFA (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFX

SEQ ID NO: 327553 - protein, 15 aa, Artificial Sequence
  Description of Artificial Sequence: Synthetic peptide
  Seed: GNKHFLRNQPLTFAL (PMEL_HUMAN)
  Core: KHFLRNQPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GNXHFXRXQPXTFAL

SEQ ID NO: 327554 - protein, 15 aa, Artificial Sequence
  Description of Artificial Sequence: Synthetic peptide
  Seed: GNKHFLRNQPLTFAL (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXAL

SEQ ID NO: 327555 - protein, 15 aa, Artificial Sequence
  Description of Artificial Sequence: Synthetic peptide
  Seed: GNKHFLRNQPLTFAL (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXL

SEQ ID NO: 327556 - protein, 16 aa, Artificial Sequence
  Description of Artificial Sequence: Synthetic peptide
  Seed: GNKHFLRNQPLTFALQ (PMEL_HUMAN)
  Core: KHFLRNQPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GNXHFXRXQPXTFALQ

SEQ ID NO: 327557 - protein, 16 aa, Artificial Sequence
  Description of Artificial Sequence: Synthetic peptide
  Seed: GNKHFLRNQPLTFALQ (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQ

SEQ ID NO: 327558 - protein, 16 aa, Artificial Sequence
  Description of Artificial Sequence: Synthetic peptide
  Seed: GNKHFLRNQPLTFALQ (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQ

SEQ ID NO: 327559 - protein, 16 aa, Artificial Sequence
  Description of Artificial Sequence: Synthetic peptide
  Seed: GNKHFLRNQPLTFALQ (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQ

SEQ ID NO: 327560 - protein, 17 aa, Artificial Sequence
  Description of Artificial Sequence: Synthetic peptide
  Seed: GNKHFLRNQPLTFALQL (PMEL_HUMAN)
  Core: KHFLRNQPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GNXHFXRXQPXTFALQL

SEQ ID NO: 327561 - protein, 17 aa, Artificial Sequence
  Description of Artificial Sequence: Synthetic peptide
  Seed: GNKHFLRNQPLTFALQL (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQL

SEQ ID NO: 327562 - protein, 17 aa, Artificial Sequence
  Description of Artificial Sequence: Synthetic peptide
  Seed: GNKHFLRNQPLTFALQL (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQL

SEQ ID NO: 327563 - protein, 17 aa, Artificial Sequence
  Description of Artificial Sequence: Synthetic peptide
  Seed: GNKHFLRNQPLTFALQL (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQL

SEQ ID NO: 327564 - protein, 18 aa, Artificial Sequence
  Description of Artificial Sequence: Synthetic peptide
  Seed: GNKHFLRNQPLTFALQLH (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLH

SEQ ID NO: 327565 - protein, 18 aa, Artificial Sequence
  Description of Artificial Sequence: Synthetic peptide
  Seed: GNKHFLRNQPLTFALQLH (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQLH

SEQ ID NO: 327566 - protein, 19 aa, Artificial Sequence
  Description of Artificial Sequence: Synthetic peptide
  Seed: GNKHFLRNQPLTFALQLHD (PMEL_HUMAN)
  Core: KHFLRNQPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GNXHFXRXQPXTFALQLHD

SEQ ID NO: 327567 - protein, 19 aa, Artificial Sequence
  Description of Artificial Sequence: Synthetic peptide
  Seed: GNKHFLRNQPLTFALQLHD (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHD

SEQ ID NO: 327568 - protein, 19 aa, Artificial Sequence
  Description of Artificial Sequence: Synthetic peptide
  Seed: GNKHFLRNQPLTFALQLHD (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQLHD

SEQ ID NO: 327569 - protein, 19 aa, Artificial Sequence
  Description of Artificial Sequence: Synthetic peptide
  Seed: GNKHFLRNQPLTFALQLHD (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHD

SEQ ID NO: 327570 - protein, 19 aa, Artificial Sequence
  Description of Artificial Sequence: Synthetic peptide
  Seed: GNKHFLRNQPLTFALQLHD (PMEL_HUMAN)
  Core: NQPLTFALQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRXQPXTXALXLHD

SEQ ID NO: 327571 - protein, 19 aa, Artificial Sequence
  Description of Artificial Sequence: Synthetic peptide
  Seed: GNKHFLRNQPLTFALQLHD (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXD

SEQ ID NO: 327572 - protein, 19 aa, Artificial Sequence
  Description of Artificial Sequence: Synthetic peptide
  Seed: GNKHFLRNQPLTFALQLHD (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHX

SEQ ID NO: 327573 - protein, 20 aa, Artificial Sequence
  Description of Artificial Sequence: Synthetic peptide
  Seed: GNKHFLRNQPLTFALQLHDP (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHDP

SEQ ID NO: 327574 - protein, 20 aa, Artificial Sequence
  Description of Artificial Sequence: Synthetic peptide
  Seed: GNKHFLRNQPLTFALQLHDP (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQLHDP

SEQ ID NO: 327575 - protein, 20 aa, Artificial Sequence
  Description of Artificial Sequence: Synthetic peptide
  Seed: GNKHFLRNQPLTFALQLHDP (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHDP

SEQ ID NO: 327576 - protein, 20 aa, Artificial Sequence
  Description of Artificial Sequence: Synthetic peptide
  Seed: GNKHFLRNQPLTFALQLHDP (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXDP

SEQ ID NO: 327577 - protein, 20 aa, Artificial Sequence
  Description of Artificial Sequence: Synthetic peptide
  Seed: GNKHFLRNQPLTFALQLHDP (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHXP

SEQ ID NO: 327578 - protein, 21 aa, Artificial Sequence
  Description of Artificial Sequence: Synthetic peptide
  Seed: GNKHFLRNQPLTFALQLHDPS (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHDPS

SEQ ID NO: 327579 - protein, 21 aa, Artificial Sequence
  Description of Artificial Sequence: Synthetic peptide
  Seed: GNKHFLRNQPLTFALQLHDPS (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQLHDPS

SEQ ID NO: 327580 - protein, 21 aa, Artificial Sequence
  Description of Artificial Sequence: Synthetic peptide
  Seed: GNKHFLRNQPLTFALQLHDPS (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHDPS

SEQ ID NO: 327581 - protein, 21 aa, Artificial Sequence
  Description of Artificial Sequence: Synthetic peptide
  Seed: GNKHFLRNQPLTFALQLHDPS (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXDPS

SEQ ID NO: 327582 - protein, 21 aa, Artificial Sequence
  Description of Artificial Sequence: Synthetic peptide
  Seed: GNKHFLRNQPLTFALQLHDPS (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHXPS

SEQ ID NO: 327583 - protein, 22 aa, Artificial Sequence
  Description of Artificial Sequence: Synthetic peptide
  Seed: GNKHFLRNQPLTFALQLHDPSG (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHDPSG

SEQ ID NO: 327584 - protein, 22 aa, Artificial Sequence
  Description of Artificial Sequence: Synthetic peptide
  Seed: GNKHFLRNQPLTFALQLHDPSG (PMEL_HUMAN)
  Core: LRNQPLTFA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFXRNXPXTFXLQLHDPSG

SEQ ID NO: 327585 - protein, 22 aa, Artificial Sequence
  Description of Artificial Sequence: Synthetic peptide
  Seed: GNKHFLRNQPLTFALQLHDPSG (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHDPSG

SEQ ID NO: 327586 - protein, 22 aa, Artificial Sequence
  Description of Artificial Sequence: Synthetic peptide
  Seed: GNKHFLRNQPLTFALQLHDPSG (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXDPSG

SEQ ID NO: 327587 - protein, 22 aa, Artificial Sequence
  Description of Artificial Sequence: Synthetic peptide
  Seed: GNKHFLRNQPLTFALQLHDPSG (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHXPSG

SEQ ID NO: 327588 - protein, 23 aa, Artificial Sequence
  Description of Artificial Sequence: Synthetic peptide
  Seed: GNKHFLRNQPLTFALQLHDPSGY (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHDPSGY

SEQ ID NO: 327589 - protein, 23 aa, Artificial Sequence
  Description of Artificial Sequence: Synthetic peptide
  Seed: GNKHFLRNQPLTFALQLHDPSGY (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHDPSGY

SEQ ID NO: 327590 - protein, 23 aa, Artificial Sequence
  Description of Artificial Sequence: Synthetic peptide
  Seed: GNKHFLRNQPLTFALQLHDPSGY (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXDPSGY

SEQ ID NO: 327591 - protein, 23 aa, Artificial Sequence
  Description of Artificial Sequence: Synthetic peptide
  Seed: GNKHFLRNQPLTFALQLHDPSGY (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHXPSGY

SEQ ID NO: 327592 - protein, 23 aa, Artificial Sequence
  Description of Artificial Sequence: Synthetic peptide
  Seed: GNKHFLRNQPLTFALQLHDPSGY (PMEL_HUMAN)
  Core: FALQLHDPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPLTXALXLXDPXGY

SEQ ID NO: 327593 - protein, 24 aa, Artificial Sequence
  Description of Artificial Sequence: Synthetic peptide
  Seed: GNKHFLRNQPLTFALQLHDPSGYL (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHDPSGYL

SEQ ID NO: 327594 - protein, 24 aa, Artificial Sequence
  Description of Artificial Sequence: Synthetic peptide
  Seed: GNKHFLRNQPLTFALQLHDPSGYL (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHDPSGYL

SEQ ID NO: 327595 - protein, 24 aa, Artificial Sequence
  Description of Artificial Sequence: Synthetic peptide
  Seed: GNKHFLRNQPLTFALQLHDPSGYL (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXDPSGYL

SEQ ID NO: 327596 - protein, 24 aa, Artificial Sequence
  Description of Artificial Sequence: Synthetic peptide
  Seed: GNKHFLRNQPLTFALQLHDPSGYL (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHXPSGYL

SEQ ID NO: 327597 - protein, 24 aa, Artificial Sequence
  Description of Artificial Sequence: Synthetic peptide
  Seed: GNKHFLRNQPLTFALQLHDPSGYL (PMEL_HUMAN)
  Core: FALQLHDPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPLTXALXLXDPXGYL

SEQ ID NO: 327598 - protein, 25 aa, Artificial Sequence
  Description of Artificial Sequence: Synthetic peptide
  Seed: GNKHFLRNQPLTFALQLHDPSGYLA (PMEL_HUMAN)
  Core: FLRNQPLTF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GNKHXLRXQXLTXALQLHDPSGYLA

SEQ ID NO: 327599 - protein, 25 aa, Artificial Sequence
  Description of Artificial Sequence: Synthetic peptide
  Seed: GNKHFLRNQPLTFALQLHDPSGYLA (PMEL_HUMAN)
  Core: RNQPLTFAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLXNQXLXFAXQLHDPSGYLA

SEQ ID NO: 327600 - protein, 25 aa, Artificial Sequence
  Description of Artificial Sequence: Synthetic peptide
  Seed: GNKHFLRNQPLTFALQLHDPSGYLA (PMEL_HUMAN)
  Core: PLTFALQLH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQXLTXAXQLXDPSGYLA

SEQ ID NO: 327601 - protein, 25 aa, Artificial Sequence
  Description of Artificial Sequence: Synthetic peptide
  Seed: GNKHFLRNQPLTFALQLHDPSGYLA (PMEL_HUMAN)
  Core: LTFALQLHD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPXTFXLXLHXPSGYLA

SEQ ID NO: 327602 - protein, 25 aa, Artificial Sequence
  Description of Artificial Sequence: Synthetic peptide
  Seed: GNKHFLRNQPLTFALQLHDPSGYLA (PMEL_HUMAN)
  Core: FALQLHDPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GNKHFLRNQPLTXALXLXDPXGYLA

SEQ ID NO: 327603 - protein, 19 aa, Artificial Sequence
  Description of Artificial Sequence: Synthetic peptide
  Seed: GPCPSGSWSQKRSFVYVWK (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWK

SEQ ID NO: 327604 - protein, 20 aa, Artificial Sequence
  Description of Artificial Sequence: Synthetic peptide
  Seed: GPCPSGSWSQKRSFVYVWKT (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWKT

SEQ ID NO: 327605 - protein, 20 aa, Artificial Sequence
  Description of Artificial Sequence: Synthetic peptide
  Seed: GPCPSGSWSQKRSFVYVWKT (PMEL_HUMAN)
  Core: RSFVYVWKT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKXSFXYXWKX

SEQ ID NO: 327606 - protein, 21 aa, Artificial Sequence
  Description of Artificial Sequence: Synthetic peptide
  Seed: GPCPSGSWSQKRSFVYVWKTW (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWKTW

SEQ ID NO: 327607 - protein, 21 aa, Artificial Sequence
  Description of Artificial Sequence: Synthetic peptide
  Seed: GPCPSGSWSQKRSFVYVWKTW (PMEL_HUMAN)
  Core: RSFVYVWKT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKXSFXYXWKXW

SEQ ID NO: 327608 - protein, 22 aa, Artificial Sequence
  Description of Artificial Sequence: Synthetic peptide
  Seed: GPCPSGSWSQKRSFVYVWKTWG (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWKTWG

SEQ ID NO: 327609 - protein, 22 aa, Artificial Sequence
  Description of Artificial Sequence: Synthetic peptide
  Seed: GPCPSGSWSQKRSFVYVWKTWG (PMEL_HUMAN)
  Core: RSFVYVWKT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKXSFXYXWKXWG

SEQ ID NO: 327610 - protein, 22 aa, Artificial Sequence
  Description of Artificial Sequence: Synthetic peptide
  Seed: GPCPSGSWSQKRSFVYVWKTWG (PMEL_HUMAN)
  Core: FVYVWKTWG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSXVYXWXTWX

SEQ ID NO: 327611 - protein, 23 aa, Artificial Sequence
  Description of Artificial Sequence: Synthetic peptide
  Seed: GPCPSGSWSQKRSFVYVWKTWGQ (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWKTWGQ

SEQ ID NO: 327612 - protein, 23 aa, Artificial Sequence
  Description of Artificial Sequence: Synthetic peptide
  Seed: GPCPSGSWSQKRSFVYVWKTWGQ (PMEL_HUMAN)
  Core: RSFVYVWKT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKXSFXYXWKXWGQ

SEQ ID NO: 327613 - protein, 23 aa, Artificial Sequence
  Description of Artificial Sequence: Synthetic peptide
  Seed: GPCPSGSWSQKRSFVYVWKTWGQ (PMEL_HUMAN)
  Core: FVYVWKTWG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSXVYXWXTWXQ

SEQ ID NO: 327614 - protein, 23 aa, Artificial Sequence
  Description of Artificial Sequence: Synthetic peptide
  Seed: GPCPSGSWSQKRSFVYVWKTWGQ (PMEL_HUMAN)
  Core: VYVWKTWGQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSFXYVXKXWGX

SEQ ID NO: 327615 - protein, 24 aa, Artificial Sequence
  Description of Artificial Sequence: Synthetic peptide
  Seed: GPCPSGSWSQKRSFVYVWKTWGQY (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWKTWGQY

SEQ ID NO: 327616 - protein, 24 aa, Artificial Sequence
  Description of Artificial Sequence: Synthetic peptide
  Seed: GPCPSGSWSQKRSFVYVWKTWGQY (PMEL_HUMAN)
  Core: RSFVYVWKT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKXSFXYXWKXWGQY

SEQ ID NO: 327617 - protein, 24 aa, Artificial Sequence
  Description of Artificial Sequence: Synthetic peptide
  Seed: GPCPSGSWSQKRSFVYVWKTWGQY (PMEL_HUMAN)
  Core: FVYVWKTWG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSXVYXWXTWXQY

SEQ ID NO: 327618 - protein, 24 aa, Artificial Sequence
  Description of Artificial Sequence: Synthetic peptide
  Seed: GPCPSGSWSQKRSFVYVWKTWGQY (PMEL_HUMAN)
  Core: VYVWKTWGQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSFXYVXKXWGXY

SEQ ID NO: 327619 - protein, 25 aa, Artificial Sequence
  Description of Artificial Sequence: Synthetic peptide
  Seed: GPCPSGSWSQKRSFVYVWKTWGQYW (PMEL_HUMAN)
  Core: WSQKRSFVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSXSQXRXFVXVWKTWGQYW

SEQ ID NO: 327620 - protein, 25 aa, Artificial Sequence
  Description of Artificial Sequence: Synthetic peptide
  Seed: GPCPSGSWSQKRSFVYVWKTWGQYW (PMEL_HUMAN)
  Core: RSFVYVWKT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKXSFXYXWKXWGQYW

SEQ ID NO: 327621 - protein, 25 aa, Artificial Sequence
  Description of Artificial Sequence: Synthetic peptide
  Seed: GPCPSGSWSQKRSFVYVWKTWGQYW (PMEL_HUMAN)
  Core: FVYVWKTWG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSXVYXWXTWXQYW

SEQ ID NO: 327622 - protein, 25 aa, Artificial Sequence
  Description of Artificial Sequence: Synthetic peptide
  Seed: GPCPSGSWSQKRSFVYVWKTWGQYW (PMEL_HUMAN)
  Core: VYVWKTWGQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSFXYVXKXWGXYW

SEQ ID NO: 327623 - protein, 25 aa, Artificial Sequence
  Description of Artificial Sequence: Synthetic peptide
  Seed: GPCPSGSWSQKRSFVYVWKTWGQYW (PMEL_HUMAN)
  Core: YVWKTWGQY
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GPCPSGSWSQKRSFVXVWXTXGQXW

SEQ ID NO: 327624 - protein, 13 aa, Artificial Sequence
  Description of Artificial Sequence: Synthetic peptide
  Seed: GPDASSIMSTESI (PMEL_HUMAN)
  Core: PDASSIMST
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXDAXSXMSXESI

SEQ ID NO: 327625 - protein, 14 aa, Artificial Sequence
  Description of Artificial Sequence: Synthetic peptide
  Seed: GPDASSIMSTESIT (PMEL_HUMAN)
  Core: PDASSIMST
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXDAXSXMSXESIT

SEQ ID NO: 327626 - protein, 14 aa, Artificial Sequence
  Description of Artificial Sequence: Synthetic peptide
  Seed: GPDASSIMSTESIT (PMEL_HUMAN)
  Core: ASSIMSTES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPDXSSXMXTEXIT

SEQ ID NO: 327627 - protein, 15 aa, Artificial Sequence
  Description of Artificial Sequence: Synthetic peptide
  Seed: GPDASSIMSTESITG (PMEL_HUMAN)
  Core: PDASSIMST
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXDAXSXMSXESITG

SEQ ID NO: 327628 - protein, 15 aa, Artificial Sequence
  Description of Artificial Sequence: Synthetic peptide
  Seed: GPDASSIMSTESITG (PMEL_HUMAN)
  Core: ASSIMSTES
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPDXSSXMXTEXITG

SEQ ID NO: 327629 - protein, 16 aa, Artificial Sequence
  Description of Artificial Sequence: Synthetic peptide
  Seed: GPDASSIMSTESITGS (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXS

SEQ ID NO: 327630 - protein, 17 aa, Artificial Sequence
  Description of Artificial Sequence: Synthetic peptide
  Seed: GPDASSIMSTESITGSL (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSL

SEQ ID NO: 327631 - protein, 18 aa, Artificial Sequence
  Description of Artificial Sequence: Synthetic peptide
  Seed: GPDASSIMSTESITGSLG (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSLG

SEQ ID NO: 327632 - protein, 19 aa, Artificial Sequence
  Description of Artificial Sequence: Synthetic peptide
  Seed: GPDASSIMSTESITGSLGP (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSLGP

SEQ ID NO: 327633 - protein, 20 aa, Artificial Sequence
  Description of Artificial Sequence: Synthetic peptide
  Seed: GPDASSIMSTESITGSLGPL (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSLGPL

SEQ ID NO: 327634 - protein, 20 aa, Artificial Sequence
  Description of Artificial Sequence: Synthetic peptide
  Seed: GPDASSIMSTESITGSLGPL (PMEL_HUMAN)
  Core: MSTESITGS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIXSTXSXTGXLGPL

SEQ ID NO: 327635 - protein, 21 aa, Artificial Sequence
  Description of Artificial Sequence: Synthetic peptide
  Seed: GPDASSIMSTESITGSLGPLL (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSLGPLL

SEQ ID NO: 327636 - protein, 22 aa, Artificial Sequence
  Description of Artificial Sequence: Synthetic peptide
  Seed: GPDASSIMSTESITGSLGPLLD (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSLGPLLD

SEQ ID NO: 327637 - protein, 22 aa, Artificial Sequence
  Description of Artificial Sequence: Synthetic peptide
  Seed: GPDASSIMSTESITGSLGPLLD (PMEL_HUMAN)
  Core: ITGSLGPLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTESXTGXLXPLXD

SEQ ID NO: 327638 - protein, 23 aa, Artificial Sequence
  Description of Artificial Sequence: Synthetic peptide
  Seed: GPDASSIMSTESITGSLGPLLDG (PMEL_HUMAN)
  Core: IMSTESITG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSXMSXEXITXSLGPLLDG

SEQ ID NO: 327639 - protein, 23 aa, Artificial Sequence
  Description of Artificial Sequence: Synthetic peptide
  Seed: GPDASSIMSTESITGSLGPLLDG (PMEL_HUMAN)
  Core: SITGSLGPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTEXITXSXGPXLDG

SEQ ID NO: 327640 - protein, 23 aa, Artificial Sequence
  Description of Artificial Sequence: Synthetic peptide
  Seed: GPDASSIMSTESITGSLGPLLDG (PMEL_HUMAN)
  Core: ITGSLGPLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTESXTGXLXPLXDG

SEQ ID NO: 327641 - protein, 24 aa, Artificial Sequence
  Description of Artificial Sequence: Synthetic peptide
  Seed: GPDASSIMSTESITGSLGPLLDGT (PMEL_HUMAN)
  Core: SITGSLGPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTEXITXSXGPXLDGT

SEQ ID NO: 327642 - protein, 24 aa, Artificial Sequence
  Description of Artificial Sequence: Synthetic peptide
  Seed: GPDASSIMSTESITGSLGPLLDGT (PMEL_HUMAN)
  Core: ITGSLGPLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTESXTGXLXPLXDGT

SEQ ID NO: 327643 - protein, 25 aa, Artificial Sequence
  Description of Artificial Sequence: Synthetic peptide
  Seed: GPDASSIMSTESITGSLGPLLDGTA (PMEL_HUMAN)
  Core: SITGSLGPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTEXITXSXGPXLDGTA

SEQ ID NO: 327644 - protein, 25 aa, Artificial Sequence
  Description of Artificial Sequence: Synthetic peptide
  Seed: GPDASSIMSTESITGSLGPLLDGTA (PMEL_HUMAN)
  Core: ITGSLGPLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GPDASSIMSTESXTGXLXPLXDGTA

SEQ ID NO: 327645 - protein, 14 aa, Artificial Sequence
  Description of Artificial Sequence: Synthetic peptide
  Seed: GPLLDGTATLRLVK (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVK

SEQ ID NO: 327646 - protein, 15 aa, Artificial Sequence
  Description of Artificial Sequence: Synthetic peptide
  Seed: GPLLDGTATLRLVKR (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKR

SEQ ID NO: 327647 - protein, 16 aa, Artificial Sequence
  Description of Artificial Sequence: Synthetic peptide
  Seed: GPLLDGTATLRLVKRQ (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQ

SEQ ID NO: 327648 - protein, 16 aa, Artificial Sequence
  Description of Artificial Sequence: Synthetic peptide
  Seed: GPLLDGTATLRLVKRQ (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQ

SEQ ID NO: 327649 - protein, 17 aa, Artificial Sequence
  Description of Artificial Sequence: Synthetic peptide
  Seed: GPLLDGTATLRLVKRQV (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQV

SEQ ID NO: 327650 - protein, 17 aa, Artificial Sequence
  Description of Artificial Sequence: Synthetic peptide
  Seed: GPLLDGTATLRLVKRQV (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQV

SEQ ID NO: 327651 - protein, 18 aa, Artificial Sequence
  Description of Artificial Sequence: Synthetic peptide
  Seed: GPLLDGTATLRLVKRQVP (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVP

SEQ ID NO: 327652 - protein, 18 aa, Artificial Sequence
  Description of Artificial Sequence: Synthetic peptide
  Seed: GPLLDGTATLRLVKRQVP (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVP

SEQ ID NO: 327653 - protein, 18 aa, Artificial Sequence
  Description of Artificial Sequence: Synthetic peptide
  Seed: GPLLDGTATLRLVKRQVP (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVX

SEQ ID NO: 327654 - protein, 19 aa, Artificial Sequence
  Description of Artificial Sequence: Synthetic peptide
  Seed: GPLLDGTATLRLVKRQVPL (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPL

SEQ ID NO: 327655 - protein, 19 aa, Artificial Sequence
  Description of Artificial Sequence: Synthetic peptide
  Seed: GPLLDGTATLRLVKRQVPL (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPL

SEQ ID NO: 327656 - protein, 19 aa, Artificial Sequence
  Description of Artificial Sequence: Synthetic peptide
  Seed: GPLLDGTATLRLVKRQVPL (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPL

SEQ ID NO: 327657 - protein, 19 aa, Artificial Sequence
  Description of Artificial Sequence: Synthetic peptide
  Seed: GPLLDGTATLRLVKRQVPL (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXL

SEQ ID NO: 327658 - protein, 20 aa, Artificial Sequence
  Description of Artificial Sequence: Synthetic peptide
  Seed: GPLLDGTATLRLVKRQVPLD (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPLD

SEQ ID NO: 327659 - protein, 20 aa, Artificial Sequence
  Description of Artificial Sequence: Synthetic peptide
  Seed: GPLLDGTATLRLVKRQVPLD (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPLD

SEQ ID NO: 327660 - protein, 20 aa, Artificial Sequence
  Description of Artificial Sequence: Synthetic peptide
  Seed: GPLLDGTATLRLVKRQVPLD (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPLD

SEQ ID NO: 327661 - protein, 20 aa, Artificial Sequence
  Description of Artificial Sequence: Synthetic peptide
  Seed: GPLLDGTATLRLVKRQVPLD (PMEL_HUMAN)
  Core: TLRLVKRQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTAXLRXVXRQXPLD

SEQ ID NO: 327662 - protein, 20 aa, Artificial Sequence
  Description of Artificial Sequence: Synthetic peptide
  Seed: GPLLDGTATLRLVKRQVPLD (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXLD

SEQ ID NO: 327663 - protein, 21 aa, Artificial Sequence
  Description of Artificial Sequence: Synthetic peptide
  Seed: GPLLDGTATLRLVKRQVPLDC (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPLDC

SEQ ID NO: 327664 - protein, 21 aa, Artificial Sequence
  Description of Artificial Sequence: Synthetic peptide
  Seed: GPLLDGTATLRLVKRQVPLDC (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPLDC

SEQ ID NO: 327665 - protein, 21 aa, Artificial Sequence
  Description of Artificial Sequence: Synthetic peptide
  Seed: GPLLDGTATLRLVKRQVPLDC (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPLDC

SEQ ID NO: 327666 - protein, 21 aa, Artificial Sequence
  Description of Artificial Sequence: Synthetic peptide
  Seed: GPLLDGTATLRLVKRQVPLDC (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXLDC

SEQ ID NO: 327667 - protein, 22 aa, Artificial Sequence
  Description of Artificial Sequence: Synthetic peptide
  Seed: GPLLDGTATLRLVKRQVPLDCV (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPLDCV

SEQ ID NO: 327668 - protein, 22 aa, Artificial Sequence
  Description of Artificial Sequence: Synthetic peptide
  Seed: GPLLDGTATLRLVKRQVPLDCV (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPLDCV

SEQ ID NO: 327669 - protein, 22 aa, Artificial Sequence
  Description of Artificial Sequence: Synthetic peptide
  Seed: GPLLDGTATLRLVKRQVPLDCV (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPLDCV

SEQ ID NO: 327670 - protein, 22 aa, Artificial Sequence
  Description of Artificial Sequence: Synthetic peptide
  Seed: GPLLDGTATLRLVKRQVPLDCV (PMEL_HUMAN)
  Core: TLRLVKRQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTAXLRXVXRQXPLDCV

SEQ ID NO: 327671 - protein, 22 aa, Artificial Sequence
  Description of Artificial Sequence: Synthetic peptide
  Seed: GPLLDGTATLRLVKRQVPLDCV (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXLDCV

SEQ ID NO: 327672 - protein, 22 aa, Artificial Sequence
  Description of Artificial Sequence: Synthetic peptide
  Seed: GPLLDGTATLRLVKRQVPLDCV (PMEL_HUMAN)
  Core: LVKRQVPLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLRXVKXQXPLXCV

SEQ ID NO: 327673 - protein, 23 aa, Artificial Sequence
  Description of Artificial Sequence: Synthetic peptide
  Seed: GPLLDGTATLRLVKRQVPLDCVL (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPLDCVL

SEQ ID NO: 327674 - protein, 23 aa, Artificial Sequence
  Description of Artificial Sequence: Synthetic peptide
  Seed: GPLLDGTATLRLVKRQVPLDCVL (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPLDCVL

SEQ ID NO: 327675 - protein, 23 aa, Artificial Sequence
  Description of Artificial Sequence: Synthetic peptide
  Seed: GPLLDGTATLRLVKRQVPLDCVL (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPLDCVL

SEQ ID NO: 327676 - protein, 23 aa, Artificial Sequence
  Description of Artificial Sequence: Synthetic peptide
  Seed: GPLLDGTATLRLVKRQVPLDCVL (PMEL_HUMAN)
  Core: TLRLVKRQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTAXLRXVXRQXPLDCVL

SEQ ID NO: 327677 - protein, 23 aa, Artificial Sequence
  Description of Artificial Sequence: Synthetic peptide
  Seed: GPLLDGTATLRLVKRQVPLDCVL (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXLDCVL

SEQ ID NO: 327678 - protein, 23 aa, Artificial Sequence
  Description of Artificial Sequence: Synthetic peptide
  Seed: GPLLDGTATLRLVKRQVPLDCVL (PMEL_HUMAN)
  Core: LVKRQVPLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLRXVKXQXPLXCVL

SEQ ID NO: 327679 - protein, 24 aa, Artificial Sequence
  Description of Artificial Sequence: Synthetic peptide
  Seed: GPLLDGTATLRLVKRQVPLDCVLY (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPLDCVLY

SEQ ID NO: 327680 - protein, 24 aa, Artificial Sequence
  Description of Artificial Sequence: Synthetic peptide
  Seed: GPLLDGTATLRLVKRQVPLDCVLY (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPLDCVLY

SEQ ID NO: 327681 - protein, 24 aa, Artificial Sequence
  Description of Artificial Sequence: Synthetic peptide
  Seed: GPLLDGTATLRLVKRQVPLDCVLY (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPLDCVLY

SEQ ID NO: 327682 - protein, 24 aa, Artificial Sequence
  Description of Artificial Sequence: Synthetic peptide
  Seed: GPLLDGTATLRLVKRQVPLDCVLY (PMEL_HUMAN)
  Core: TLRLVKRQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTAXLRXVXRQXPLDCVLY

SEQ ID NO: 327683 - protein, 24 aa, Artificial Sequence
  Description of Artificial Sequence: Synthetic peptide
  Seed: GPLLDGTATLRLVKRQVPLDCVLY (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXLDCVLY

SEQ ID NO: 327684 - protein, 24 aa, Artificial Sequence
  Description of Artificial Sequence: Synthetic peptide
  Seed: GPLLDGTATLRLVKRQVPLDCVLY (PMEL_HUMAN)
  Core: RLVKRQVPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLXLVXRXVPXDCVLY

SEQ ID NO: 327685 - protein, 24 aa, Artificial Sequence
  Description of Artificial Sequence: Synthetic peptide
  Seed: GPLLDGTATLRLVKRQVPLDCVLY (PMEL_HUMAN)
  Core: LVKRQVPLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLRXVKXQXPLXCVLY

SEQ ID NO: 327686 - protein, 25 aa, Artificial Sequence
  Description of Artificial Sequence: Synthetic peptide
  Seed: GPLLDGTATLRLVKRQVPLDCVLYR (PMEL_HUMAN)
  Core: LDGTATLRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPLXDGXAXLRXVKRQVPLDCVLYR

SEQ ID NO: 327687 - protein, 25 aa, Artificial Sequence
  Description of Artificial Sequence: Synthetic peptide
  Seed: GPLLDGTATLRLVKRQVPLDCVLYR (PMEL_HUMAN)
  Core: DGTATLRLV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPLLXGTXTXRLXKRQVPLDCVLYR

SEQ ID NO: 327688 - protein, 25 aa, Artificial Sequence
  Description of Artificial Sequence: Synthetic peptide
  Seed: GPLLDGTATLRLVKRQVPLDCVLYR (PMEL_HUMAN)
  Core: TATLRLVKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGXATXRXVKXQVPLDCVLYR

SEQ ID NO: 327689 - protein, 25 aa, Artificial Sequence
  Description of Artificial Sequence: Synthetic peptide
  Seed: GPLLDGTATLRLVKRQVPLDCVLYR (PMEL_HUMAN)
  Core: TLRLVKRQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTAXLRXVXRQXPLDCVLYR

SEQ ID NO: 327690 - protein, 25 aa, Artificial Sequence
  Description of Artificial Sequence: Synthetic peptide
  Seed: GPLLDGTATLRLVKRQVPLDCVLYR (PMEL_HUMAN)
  Core: LRLVKRQVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATXRLXKXQVXLDCVLYR

SEQ ID NO: 327691 - protein, 25 aa, Artificial Sequence
  Description of Artificial Sequence: Synthetic peptide
  Seed: GPLLDGTATLRLVKRQVPLDCVLYR (PMEL_HUMAN)
  Core: RLVKRQVPL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLXLVXRXVPXDCVLYR

SEQ ID NO: 327692 - protein, 25 aa, Artificial Sequence
  Description of Artificial Sequence: Synthetic peptide
  Seed: GPLLDGTATLRLVKRQVPLDCVLYR (PMEL_HUMAN)
  Core: LVKRQVPLD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLRXVKXQXPLXCVLYR

SEQ ID NO: 327693 - protein, 25 aa, Artificial Sequence
  Description of Artificial Sequence: Synthetic peptide
  Seed: GPLLDGTATLRLVKRQVPLDCVLYR (PMEL_HUMAN)
  Core: VKRQVPLDC
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GPLLDGTATLRLXKRXVXLDXVLYR

SEQ ID NO: 327694 - protein, 13 aa, Artificial Sequence
  Description of Artificial Sequence: Synthetic peptide
  Seed: GPTLIGANASFSI (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXI

SEQ ID NO: 327695 - protein, 13 aa, Artificial Sequence
  Description of Artificial Sequence: Synthetic peptide
  Seed: GPTLIGANASFSI (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSX

SEQ ID NO: 327696 - protein, 14 aa, Artificial Sequence
  Description of Artificial Sequence: Synthetic peptide
  Seed: GPTLIGANASFSIA (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIA

SEQ ID NO: 327697 - protein, 14 aa, Artificial Sequence
  Description of Artificial Sequence: Synthetic peptide
  Seed: GPTLIGANASFSIA (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXA

SEQ ID NO: 327698 - protein, 15 aa, Artificial Sequence
  Description of Artificial Sequence: Synthetic peptide
  Seed: GPTLIGANASFSIAL (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIAL

SEQ ID NO: 327699 - protein, 15 aa, Artificial Sequence
  Description of Artificial Sequence: Synthetic peptide
  Seed: GPTLIGANASFSIAL (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXAL

SEQ ID NO: 327700 - protein, 16 aa, Artificial Sequence
  Description of Artificial Sequence: Synthetic peptide
  Seed: GPTLIGANASFSIALN (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALN

SEQ ID NO: 327701 - protein, 16 aa, Artificial Sequence
  Description of Artificial Sequence: Synthetic peptide
  Seed: GPTLIGANASFSIALN (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALN

SEQ ID NO: 327702 - protein, 17 aa, Artificial Sequence
  Description of Artificial Sequence: Synthetic peptide
  Seed: GPTLIGANASFSIALNF (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNF

SEQ ID NO: 327703 - protein, 17 aa, Artificial Sequence
  Description of Artificial Sequence: Synthetic peptide
  Seed: GPTLIGANASFSIALNF (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNF

SEQ ID NO: 327704 - protein, 18 aa, Artificial Sequence
  Description of Artificial Sequence: Synthetic peptide
  Seed: GPTLIGANASFSIALNFP (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFP

SEQ ID NO: 327705 - protein, 18 aa, Artificial Sequence
  Description of Artificial Sequence: Synthetic peptide
  Seed: GPTLIGANASFSIALNFP (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFP

SEQ ID NO: 327706 - protein, 18 aa, Artificial Sequence
  Description of Artificial Sequence: Synthetic peptide
  Seed: GPTLIGANASFSIALNFP (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFP

SEQ ID NO: 327707 - protein, 19 aa, Artificial Sequence
  Description of Artificial Sequence: Synthetic peptide
  Seed: GPTLIGANASFSIALNFPG (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPG

SEQ ID NO: 327708 - protein, 19 aa, Artificial Sequence
  Description of Artificial Sequence: Synthetic peptide
  Seed: GPTLIGANASFSIALNFPG (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPG

SEQ ID NO: 327709 - protein, 19 aa, Artificial Sequence
  Description of Artificial Sequence: Synthetic peptide
  Seed: GPTLIGANASFSIALNFPG (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPG

SEQ ID NO: 327710 - protein, 19 aa, Artificial Sequence
  Description of Artificial Sequence: Synthetic peptide
  Seed: GPTLIGANASFSIALNFPG (PMEL_HUMAN)
  Core: ASFSIALNF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANXSFXIXLNXPG

SEQ ID NO: 327711 - protein, 19 aa, Artificial Sequence
  Description of Artificial Sequence: Synthetic peptide
  Seed: GPTLIGANASFSIALNFPG (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPX

SEQ ID NO: 327712 - protein, 20 aa, Artificial Sequence
  Description of Artificial Sequence: Synthetic peptide
  Seed: GPTLIGANASFSIALNFPGS (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPGS

SEQ ID NO: 327713 - protein, 20 aa, Artificial Sequence
  Description of Artificial Sequence: Synthetic peptide
  Seed: GPTLIGANASFSIALNFPGS (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPGS

SEQ ID NO: 327714 - protein, 20 aa, Artificial Sequence
  Description of Artificial Sequence: Synthetic peptide
  Seed: GPTLIGANASFSIALNFPGS (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPGS

SEQ ID NO: 327715 - protein, 20 aa, Artificial Sequence
  Description of Artificial Sequence: Synthetic peptide
  Seed: GPTLIGANASFSIALNFPGS (PMEL_HUMAN)
  Core: ASFSIALNF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANXSFXIXLNXPGS

SEQ ID NO: 327716 - protein, 20 aa, Artificial Sequence
  Description of Artificial Sequence: Synthetic peptide
  Seed: GPTLIGANASFSIALNFPGS (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPXS

SEQ ID NO: 327717 - protein, 21 aa, Artificial Sequence
  Description of Artificial Sequence: Synthetic peptide
  Seed: GPTLIGANASFSIALNFPGSQ (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPGSQ

SEQ ID NO: 327718 - protein, 21 aa, Artificial Sequence
  Description of Artificial Sequence: Synthetic peptide
  Seed: GPTLIGANASFSIALNFPGSQ (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPGSQ

SEQ ID NO: 327719 - protein, 21 aa, Artificial Sequence
  Description of Artificial Sequence: Synthetic peptide
  Seed: GPTLIGANASFSIALNFPGSQ (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPGSQ

SEQ ID NO: 327720 - protein, 21 aa, Artificial Sequence
  Description of Artificial Sequence: Synthetic peptide
  Seed: GPTLIGANASFSIALNFPGSQ (PMEL_HUMAN)
  Core: ASFSIALNF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANXSFXIXLNXPGSQ

SEQ ID NO: 327721 - protein, 21 aa, Artificial Sequence
  Description of Artificial Sequence: Synthetic peptide
  Seed: GPTLIGANASFSIALNFPGSQ (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPXSQ

SEQ ID NO: 327722 - protein, 22 aa, Artificial Sequence
  Description of Artificial Sequence: Synthetic peptide
  Seed: GPTLIGANASFSIALNFPGSQK (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPGSQK

SEQ ID NO: 327723 - protein, 22 aa, Artificial Sequence
  Description of Artificial Sequence: Synthetic peptide
  Seed: GPTLIGANASFSIALNFPGSQK (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPGSQK

SEQ ID NO: 327724 - protein, 22 aa, Artificial Sequence
  Description of Artificial Sequence: Synthetic peptide
  Seed: GPTLIGANASFSIALNFPGSQK (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPGSQK

SEQ ID NO: 327725 - protein, 22 aa, Artificial Sequence
  Description of Artificial Sequence: Synthetic peptide
  Seed: GPTLIGANASFSIALNFPGSQK (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPXSQK

SEQ ID NO: 327726 - protein, 23 aa, Artificial Sequence
  Description of Artificial Sequence: Synthetic peptide
  Seed: GPTLIGANASFSIALNFPGSQKV (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPGSQKV

SEQ ID NO: 327727 - protein, 23 aa, Artificial Sequence
  Description of Artificial Sequence: Synthetic peptide
  Seed: GPTLIGANASFSIALNFPGSQKV (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPGSQKV

SEQ ID NO: 327728 - protein, 23 aa, Artificial Sequence
  Description of Artificial Sequence: Synthetic peptide
  Seed: GPTLIGANASFSIALNFPGSQKV (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPGSQKV

SEQ ID NO: 327729 - protein, 23 aa, Artificial Sequence
  Description of Artificial Sequence: Synthetic peptide
  Seed: GPTLIGANASFSIALNFPGSQKV (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPXSQKV

SEQ ID NO: 327730 - protein, 24 aa, Artificial Sequence
  Description of Artificial Sequence: Synthetic peptide
  Seed: GPTLIGANASFSIALNFPGSQKVL (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPGSQKVL

SEQ ID NO: 327731 - protein, 24 aa, Artificial Sequence
  Description of Artificial Sequence: Synthetic peptide
  Seed: GPTLIGANASFSIALNFPGSQKVL (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPGSQKVL

SEQ ID NO: 327732 - protein, 24 aa, Artificial Sequence
  Description of Artificial Sequence: Synthetic peptide
  Seed: GPTLIGANASFSIALNFPGSQKVL (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPGSQKVL

SEQ ID NO: 327733 - protein, 24 aa, Artificial Sequence
  Description of Artificial Sequence: Synthetic peptide
  Seed: GPTLIGANASFSIALNFPGSQKVL (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPXSQKVL

SEQ ID NO: 327734 - protein, 25 aa, Artificial Sequence
  Description of Artificial Sequence: Synthetic peptide
  Seed: GPTLIGANASFSIALNFPGSQKVLP (PMEL_HUMAN)
  Core: LIGANASFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPTXIGXNXSFXIALNFPGSQKVLP

SEQ ID NO: 327735 - protein, 25 aa, Artificial Sequence
  Description of Artificial Sequence: Synthetic peptide
  Seed: GPTLIGANASFSIALNFPGSQKVLP (PMEL_HUMAN)
  Core: IGANASFSI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GPTLXGAXAXFSXALNFPGSQKVLP

SEQ ID NO: 327736 - protein, 25 aa, Artificial Sequence
  Description of Artificial Sequence: Synthetic peptide
  Seed: GPTLIGANASFSIALNFPGSQKVLP (PMEL_HUMAN)
  Core: NASFSIALN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGAXASXSXALXFPGSQKVLP

SEQ ID NO: 327737 - protein, 25 aa, Artificial Sequence
  Description of Artificial Sequence: Synthetic peptide
  Seed: GPTLIGANASFSIALNFPGSQKVLP (PMEL_HUMAN)
  Core: FSIALNFPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASXSIXLXFPXSQKVLP

SEQ ID NO: 327738 - protein, 25 aa, Artificial Sequence
  Description of Artificial Sequence: Synthetic peptide
  Seed: GPTLIGANASFSIALNFPGSQKVLP (PMEL_HUMAN)
  Core: LNFPGSQKV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GPTLIGANASFSIAXNFXGXQKXLP

SEQ ID NO: 327739 - protein, 13 aa, Artificial Sequence
  Description of Artificial Sequence: Synthetic peptide
  Seed: GPVSGLSIGTGRA (PMEL_HUMAN)
  Core: PVSGLSIGT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXVSXLXIGXGRA

SEQ ID NO: 327740 - protein, 14 aa, Artificial Sequence
  Description of Artificial Sequence: Synthetic peptide
  Seed: GPVSGLSIGTGRAM (PMEL_HUMAN)
  Core: PVSGLSIGT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXVSXLXIGXGRAM

SEQ ID NO: 327741 - protein, 14 aa, Artificial Sequence
  Description of Artificial Sequence: Synthetic peptide
  Seed: GPVSGLSIGTGRAM (PMEL_HUMAN)
  Core: VSGLSIGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXSGXSXGTXRAM

SEQ ID NO: 327742 - protein, 15 aa, Artificial Sequence
  Description of Artificial Sequence: Synthetic peptide
  Seed: GPVSGLSIGTGRAML (PMEL_HUMAN)
  Core: PVSGLSIGT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXVSXLXIGXGRAML

SEQ ID NO: 327743 - protein, 15 aa, Artificial Sequence
  Description of Artificial Sequence: Synthetic peptide
  Seed: GPVSGLSIGTGRAML (PMEL_HUMAN)
  Core: VSGLSIGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXSGXSXGTXRAML

SEQ ID NO: 327744 - protein, 15 aa, Artificial Sequence
  Description of Artificial Sequence: Synthetic peptide
  Seed: GPVSGLSIGTGRAML (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXL

SEQ ID NO: 327745 - protein, 16 aa, Artificial Sequence
  Description of Artificial Sequence: Synthetic peptide
  Seed: GPVSGLSIGTGRAMLG (PMEL_HUMAN)
  Core: VSGLSIGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXSGXSXGTXRAMLG

SEQ ID NO: 327746 - protein, 16 aa, Artificial Sequence
  Description of Artificial Sequence: Synthetic peptide
  Seed: GPVSGLSIGTGRAMLG (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLG

SEQ ID NO: 327747 - protein, 16 aa, Artificial Sequence
  Description of Artificial Sequence: Synthetic peptide
  Seed: GPVSGLSIGTGRAMLG (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLX

SEQ ID NO: 327748 - protein, 17 aa, Artificial Sequence
  Description of Artificial Sequence: Synthetic peptide
  Seed: GPVSGLSIGTGRAMLGT (PMEL_HUMAN)
  Core: VSGLSIGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXSGXSXGTXRAMLGT

SEQ ID NO: 327749 - protein, 17 aa, Artificial Sequence
  Description of Artificial Sequence: Synthetic peptide
  Seed: GPVSGLSIGTGRAMLGT (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGT

SEQ ID NO: 327750 - protein, 17 aa, Artificial Sequence
  Description of Artificial Sequence: Synthetic peptide
  Seed: GPVSGLSIGTGRAMLGT (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXT

SEQ ID NO: 327751 - protein, 18 aa, Artificial Sequence
  Description of Artificial Sequence: Synthetic peptide
  Seed: GPVSGLSIGTGRAMLGTH (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTH

SEQ ID NO: 327752 - protein, 19 aa, Artificial Sequence
  Description of Artificial Sequence: Synthetic peptide
  Seed: GPVSGLSIGTGRAMLGTHT (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHT

SEQ ID NO: 327753 - protein, 19 aa, Artificial Sequence
  Description of Artificial Sequence: Synthetic peptide
  Seed: GPVSGLSIGTGRAMLGTHT (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHT

SEQ ID NO: 327754 - protein, 20 aa, Artificial Sequence
  Description of Artificial Sequence: Synthetic peptide
  Seed: GPVSGLSIGTGRAMLGTHTM (PMEL_HUMAN)
  Core: VSGLSIGTG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXSGXSXGTXRAMLGTHTM

SEQ ID NO: 327755 - protein, 20 aa, Artificial Sequence
  Description of Artificial Sequence: Synthetic peptide
  Seed: GPVSGLSIGTGRAMLGTHTM (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHTM

SEQ ID NO: 327756 - protein, 20 aa, Artificial Sequence
  Description of Artificial Sequence: Synthetic peptide
  Seed: GPVSGLSIGTGRAMLGTHTM (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHTM

SEQ ID NO: 327757 - protein, 21 aa, Artificial Sequence
  Description of Artificial Sequence: Synthetic peptide
  Seed: GPVSGLSIGTGRAMLGTHTME (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHTME

SEQ ID NO: 327758 - protein, 21 aa, Artificial Sequence
  Description of Artificial Sequence: Synthetic peptide
  Seed: GPVSGLSIGTGRAMLGTHTME (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHTME

SEQ ID NO: 327759 - protein, 22 aa, Artificial Sequence
  Description of Artificial Sequence: Synthetic peptide
  Seed: GPVSGLSIGTGRAMLGTHTMEV (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHTMEV

SEQ ID NO: 327760 - protein, 22 aa, Artificial Sequence
  Description of Artificial Sequence: Synthetic peptide
  Seed: GPVSGLSIGTGRAMLGTHTMEV (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHTMEV

SEQ ID NO: 327761 - protein, 22 aa, Artificial Sequence
  Description of Artificial Sequence: Synthetic peptide
  Seed: GPVSGLSIGTGRAMLGTHTMEV (PMEL_HUMAN)
  Core: MLGTHTMEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGRAXLGXHXMEX

SEQ ID NO: 327762 - protein, 23 aa, Artificial Sequence
  Description of Artificial Sequence: Synthetic peptide
  Seed: GPVSGLSIGTGRAMLGTHTMEVT (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHTMEVT

SEQ ID NO: 327763 - protein, 23 aa, Artificial Sequence
  Description of Artificial Sequence: Synthetic peptide
  Seed: GPVSGLSIGTGRAMLGTHTMEVT (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHTMEVT

SEQ ID NO: 327764 - protein, 23 aa, Artificial Sequence
  Description of Artificial Sequence: Synthetic peptide
  Seed: GPVSGLSIGTGRAMLGTHTMEVT (PMEL_HUMAN)
  Core: RAMLGTHTM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGXAMXGXHTXEVT

SEQ ID NO: 327765 - protein, 23 aa, Artificial Sequence
  Description of Artificial Sequence: Synthetic peptide
  Seed: GPVSGLSIGTGRAMLGTHTMEVT (PMEL_HUMAN)
  Core: MLGTHTMEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGRAXLGXHXMEXT

SEQ ID NO: 327766 - protein, 24 aa, Artificial Sequence
  Description of Artificial Sequence: Synthetic peptide
  Seed: GPVSGLSIGTGRAMLGTHTMEVTV (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHTMEVTV

SEQ ID NO: 327767 - protein, 24 aa, Artificial Sequence
  Description of Artificial Sequence: Synthetic peptide
  Seed: GPVSGLSIGTGRAMLGTHTMEVTV (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHTMEVTV

SEQ ID NO: 327768 - protein, 24 aa, Artificial Sequence
  Description of Artificial Sequence: Synthetic peptide
  Seed: GPVSGLSIGTGRAMLGTHTMEVTV (PMEL_HUMAN)
  Core: RAMLGTHTM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGXAMXGXHTXEVTV

SEQ ID NO: 327769 - protein, 24 aa, Artificial Sequence
  Description of Artificial Sequence: Synthetic peptide
  Seed: GPVSGLSIGTGRAMLGTHTMEVTV (PMEL_HUMAN)
  Core: MLGTHTMEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGRAXLGXHXMEXTV

SEQ ID NO: 327770 - protein, 25 aa, Artificial Sequence
  Description of Artificial Sequence: Synthetic peptide
  Seed: GPVSGLSIGTGRAMLGTHTMEVTVY (PMEL_HUMAN)
  Core: LSIGTGRAM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGXSIXTXRAXLGTHTMEVTVY

SEQ ID NO: 327771 - protein, 25 aa, Artificial Sequence
  Description of Artificial Sequence: Synthetic peptide
  Seed: GPVSGLSIGTGRAMLGTHTMEVTVY (PMEL_HUMAN)
  Core: IGTGRAMLG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSXGTXRXMLXTHTMEVTVY

SEQ ID NO: 327772 - protein, 25 aa, Artificial Sequence
  Description of Artificial Sequence: Synthetic peptide
  Seed: GPVSGLSIGTGRAMLGTHTMEVTVY (PMEL_HUMAN)
  Core: RAMLGTHTM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGXAMXGXHTXEVTVY

SEQ ID NO: 327773 - protein, 25 aa, Artificial Sequence
  Description of Artificial Sequence: Synthetic peptide
  Seed: GPVSGLSIGTGRAMLGTHTMEVTVY (PMEL_HUMAN)
  Core: MLGTHTMEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GPVSGLSIGTGRAXLGXHXMEXTVY

SEQ ID NO: 327774 - protein, 13 aa, Artificial Sequence
  Description of Artificial Sequence: Synthetic peptide
  Seed: GPVTAQVVLQAAI (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAI

SEQ ID NO: 327775 - protein, 13 aa, Artificial Sequence
  Description of Artificial Sequence: Synthetic peptide
  Seed: GPVTAQVVLQAAI (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXI

SEQ ID NO: 327776 - protein, 14 aa, Artificial Sequence
  Description of Artificial Sequence: Synthetic peptide
  Seed: GPVTAQVVLQAAIP (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIP

SEQ ID NO: 327777 - protein, 14 aa, Artificial Sequence
  Description of Artificial Sequence: Synthetic peptide
  Seed: GPVTAQVVLQAAIP (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIP

SEQ ID NO: 327778 - protein, 15 aa, Artificial Sequence
  Description of Artificial Sequence: Synthetic peptide
  Seed: GPVTAQVVLQAAIPL (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIPL

SEQ ID NO: 327779 - protein, 15 aa, Artificial Sequence
  Description of Artificial Sequence: Synthetic peptide
  Seed: GPVTAQVVLQAAIPL (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPL

SEQ ID NO: 327780 - protein, 15 aa, Artificial Sequence
  Description of Artificial Sequence: Synthetic peptide
  Seed: GPVTAQVVLQAAIPL (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPX

SEQ ID NO: 327781 - protein, 16 aa, Artificial Sequence
  Description of Artificial Sequence: Synthetic peptide
  Seed: GPVTAQVVLQAAIPLT (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIPLT

SEQ ID NO: 327782 - protein, 16 aa, Artificial Sequence
  Description of Artificial Sequence: Synthetic peptide
  Seed: GPVTAQVVLQAAIPLT (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLT

SEQ ID NO: 327783 - protein, 16 aa, Artificial Sequence
  Description of Artificial Sequence: Synthetic peptide
  Seed: GPVTAQVVLQAAIPLT (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXT

SEQ ID NO: 327784 - protein, 17 aa, Artificial Sequence
  Description of Artificial Sequence: Synthetic peptide
  Seed: GPVTAQVVLQAAIPLTS (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIPLTS

SEQ ID NO: 327785 - protein, 17 aa, Artificial Sequence
  Description of Artificial Sequence: Synthetic peptide
  Seed: GPVTAQVVLQAAIPLTS (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTS

SEQ ID NO: 327786 - protein, 17 aa, Artificial Sequence
  Description of Artificial Sequence: Synthetic peptide
  Seed: GPVTAQVVLQAAIPLTS (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTS

SEQ ID NO: 327787 - protein, 17 aa, Artificial Sequence
  Description of Artificial Sequence: Synthetic peptide
  Seed: GPVTAQVVLQAAIPLTS (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTX

SEQ ID NO: 327788 - protein, 18 aa, Artificial Sequence
  Description of Artificial Sequence: Synthetic peptide
  Seed: GPVTAQVVLQAAIPLTSC (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIPLTSC

SEQ ID NO: 327789 - protein, 18 aa, Artificial Sequence
  Description of Artificial Sequence: Synthetic peptide
  Seed: GPVTAQVVLQAAIPLTSC (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTSC

SEQ ID NO: 327790 - protein, 18 aa, Artificial Sequence
  Description of Artificial Sequence: Synthetic peptide
  Seed: GPVTAQVVLQAAIPLTSC (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSC

SEQ ID NO: 327791 - protein, 18 aa, Artificial Sequence
  Description of Artificial Sequence: Synthetic peptide
  Seed: GPVTAQVVLQAAIPLTSC (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXC

SEQ ID NO: 327792 - protein, 19 aa, Artificial Sequence
  Description of Artificial Sequence: Synthetic peptide
  Seed: GPVTAQVVLQAAIPLTSCG (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIPLTSCG

SEQ ID NO: 327793 - protein, 19 aa, Artificial Sequence
  Description of Artificial Sequence: Synthetic peptide
  Seed: GPVTAQVVLQAAIPLTSCG (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTSCG

SEQ ID NO: 327794 - protein, 19 aa, Artificial Sequence
  Description of Artificial Sequence: Synthetic peptide
  Seed: GPVTAQVVLQAAIPLTSCG (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCG

SEQ ID NO: 327795 - protein, 19 aa, Artificial Sequence
  Description of Artificial Sequence: Synthetic peptide
  Seed: GPVTAQVVLQAAIPLTSCG (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCG

SEQ ID NO: 327796 - protein, 20 aa, Artificial Sequence
  Description of Artificial Sequence: Synthetic peptide
  Seed: GPVTAQVVLQAAIPLTSCGS (PMEL_HUMAN)
  Core: VTAQVVLQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GPXTAXVXLQXAIPLTSCGS

SEQ ID NO: 327797 - protein, 20 aa, Artificial Sequence
  Description of Artificial Sequence: Synthetic peptide
  Seed: GPVTAQVVLQAAIPLTSCGS (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCGS

SEQ ID NO: 327798 - protein, 20 aa, Artificial Sequence
  Description of Artificial Sequence: Synthetic peptide
  Seed: GPVTAQVVLQAAIPLTSCGS (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCGS

SEQ ID NO: 327799 - protein, 21 aa, Artificial Sequence
  Description of Artificial Sequence: Synthetic peptide
  Seed: GPVTAQVVLQAAIPLTSCGSS (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTSCGSS

SEQ ID NO: 327800 - protein, 21 aa, Artificial Sequence
  Description of Artificial Sequence: Synthetic peptide
  Seed: GPVTAQVVLQAAIPLTSCGSS (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCGSS

SEQ ID NO: 327801 - protein, 21 aa, Artificial Sequence
  Description of Artificial Sequence: Synthetic peptide
  Seed: GPVTAQVVLQAAIPLTSCGSS (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCGSS

SEQ ID NO: 327802 - protein, 22 aa, Artificial Sequence
  Description of Artificial Sequence: Synthetic peptide
  Seed: GPVTAQVVLQAAIPLTSCGSSP (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTSCGSSP

SEQ ID NO: 327803 - protein, 22 aa, Artificial Sequence
  Description of Artificial Sequence: Synthetic peptide
  Seed: GPVTAQVVLQAAIPLTSCGSSP (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCGSSP

SEQ ID NO: 327804 - protein, 22 aa, Artificial Sequence
  Description of Artificial Sequence: Synthetic peptide
  Seed: GPVTAQVVLQAAIPLTSCGSSP (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCGSSP

SEQ ID NO: 327805 - protein, 23 aa, Artificial Sequence
  Description of Artificial Sequence: Synthetic peptide
  Seed: GPVTAQVVLQAAIPLTSCGSSPV (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTSCGSSPV

SEQ ID NO: 327806 - protein, 23 aa, Artificial Sequence
  Description of Artificial Sequence: Synthetic peptide
  Seed: GPVTAQVVLQAAIPLTSCGSSPV (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCGSSPV

SEQ ID NO: 327807 - protein, 23 aa, Artificial Sequence
  Description of Artificial Sequence: Synthetic peptide
  Seed: GPVTAQVVLQAAIPLTSCGSSPV (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCGSSPV

SEQ ID NO: 327808 - protein, 24 aa, Artificial Sequence
  Description of Artificial Sequence: Synthetic peptide
  Seed: GPVTAQVVLQAAIPLTSCGSSPVP (PMEL_HUMAN)
  Core: TAQVVLQAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GPVXAQXVXQAXIPLTSCGSSPVP

SEQ ID NO: 327809 - protein, 24 aa, Artificial Sequence
  Description of Artificial Sequence: Synthetic peptide
  Seed: GPVTAQVVLQAAIPLTSCGSSPVP (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCGSSPVP

SEQ ID NO: 327810 - protein, 24 aa, Artificial Sequence
  Description of Artificial Sequence: Synthetic peptide
  Seed: GPVTAQVVLQAAIPLTSCGSSPVP (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCGSSPVP

SEQ ID NO: 327811 - protein, 25 aa, Artificial Sequence
  Description of Artificial Sequence: Synthetic peptide
  Seed: GPVTAQVVLQAAIPLTSCGSSPVPG (PMEL_HUMAN)
  Core: VVLQAAIPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQXVLXAXIPXTSCGSSPVPG

SEQ ID NO: 327812 - protein, 25 aa, Artificial Sequence
  Description of Artificial Sequence: Synthetic peptide
  Seed: GPVTAQVVLQAAIPLTSCGSSPVPG (PMEL_HUMAN)
  Core: LQAAIPLTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVXQAXIXLTXCGSSPVPG

SEQ ID NO: 327813 - protein, 25 aa, Artificial Sequence
  Description of Artificial Sequence: Synthetic peptide
  Seed: GPVTAQVVLQAAIPLTSCGSSPVPG (PMEL_HUMAN)
  Core: LTSCGSSPV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GPVTAQVVLQAAIPXTSXGXSPXPG

SEQ ID NO: 327814 - protein, 15 aa, Artificial Sequence
  Description of Artificial Sequence: Synthetic peptide
  Seed: GQAPTAEPSGTTSVQ (PMEL_HUMAN)
  Core: APTAEPSGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXPTXEXSGXTSVQ

SEQ ID NO: 327815 - protein, 16 aa, Artificial Sequence
  Description of Artificial Sequence: Synthetic peptide
  Seed: GQAPTAEPSGTTSVQV (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQX

SEQ ID NO: 327816 - protein, 17 aa, Artificial Sequence
  Description of Artificial Sequence: Synthetic peptide
  Seed: GQAPTAEPSGTTSVQVP (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXP

SEQ ID NO: 327817 - protein, 19 aa, Artificial Sequence
  Description of Artificial Sequence: Synthetic peptide
  Seed: GQAPTAEPSGTTSVQVPTT (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTT

SEQ ID NO: 327818 - protein, 20 aa, Artificial Sequence
  Description of Artificial Sequence: Synthetic peptide
  Seed: GQAPTAEPSGTTSVQVPTTE (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTTE

SEQ ID NO: 327819 - protein, 21 aa, Artificial Sequence
  Description of Artificial Sequence: Synthetic peptide
  Seed: GQAPTAEPSGTTSVQVPTTEV (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTTEV

SEQ ID NO: 327820 - protein, 22 aa, Artificial Sequence
  Description of Artificial Sequence: Synthetic peptide
  Seed: GQAPTAEPSGTTSVQVPTTEVI (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTTEVI

SEQ ID NO: 327821 - protein, 23 aa, Artificial Sequence
  Description of Artificial Sequence: Synthetic peptide
  Seed: GQAPTAEPSGTTSVQVPTTEVIS (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTTEVIS

SEQ ID NO: 327822 - protein, 24 aa, Artificial Sequence
  Description of Artificial Sequence: Synthetic peptide
  Seed: GQAPTAEPSGTTSVQVPTTEVIST (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTTEVIST

SEQ ID NO: 327823 - protein, 25 aa, Artificial Sequence
  Description of Artificial Sequence: Synthetic peptide
  Seed: GQAPTAEPSGTTSVQVPTTEVISTA (PMEL_HUMAN)
  Core: PSGTTSVQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEXSGXTXVQXPTTEVISTA

SEQ ID NO: 327824 - protein, 25 aa, Artificial Sequence
  Description of Artificial Sequence: Synthetic peptide
  Seed: GQAPTAEPSGTTSVQVPTTEVISTA (PMEL_HUMAN)
  Core: TTSVQVPTT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQAPTAEPSGXTSXQXPTXEVISTA

SEQ ID NO: 327825 - protein, 14 aa, Artificial Sequence
  Description of Artificial Sequence: Synthetic peptide
  Seed: GQEAGLGQVPLIVG (PMEL_HUMAN)
  Core: AGLGQVPLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQEXGLXQXPLXVG

SEQ ID NO: 327826 - protein, 15 aa, Artificial Sequence
  Description of Artificial Sequence: Synthetic peptide
  Seed: GQEAGLGQVPLIVGI (PMEL_HUMAN)
  Core: AGLGQVPLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQEXGLXQXPLXVGI

SEQ ID NO: 327827 - protein, 15 aa, Artificial Sequence
  Description of Artificial Sequence: Synthetic peptide
  Seed: GQEAGLGQVPLIVGI (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGI

SEQ ID NO: 327828 - protein, 15 aa, Artificial Sequence
  Description of Artificial Sequence: Synthetic peptide
  Seed: GQEAGLGQVPLIVGI (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXI

SEQ ID NO: 327829 - protein, 16 aa, Artificial Sequence
  Description of Artificial Sequence: Synthetic peptide
  Seed: GQEAGLGQVPLIVGIL (PMEL_HUMAN)
  Core: AGLGQVPLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQEXGLXQXPLXVGIL

SEQ ID NO: 327830 - protein, 16 aa, Artificial Sequence
  Description of Artificial Sequence: Synthetic peptide
  Seed: GQEAGLGQVPLIVGIL (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXIL

SEQ ID NO: 327831 - protein, 17 aa, Artificial Sequence
  Description of Artificial Sequence: Synthetic peptide
  Seed: GQEAGLGQVPLIVGILL (PMEL_HUMAN)
  Core: AGLGQVPLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQEXGLXQXPLXVGILL

SEQ ID NO: 327832 - protein, 17 aa, Artificial Sequence
  Description of Artificial Sequence: Synthetic peptide
  Seed: GQEAGLGQVPLIVGILL (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILL

SEQ ID NO: 327833 - protein, 17 aa, Artificial Sequence
  Description of Artificial Sequence: Synthetic peptide
  Seed: GQEAGLGQVPLIVGILL (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILL

SEQ ID NO: 327834 - protein, 18 aa, Artificial Sequence
  Description of Artificial Sequence: Synthetic peptide
  Seed: GQEAGLGQVPLIVGILLV (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLV

SEQ ID NO: 327835 - protein, 19 aa, Artificial Sequence
  Description of Artificial Sequence: Synthetic peptide
  Seed: GQEAGLGQVPLIVGILLVL (PMEL_HUMAN)
  Core: AGLGQVPLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQEXGLXQXPLXVGILLVL

SEQ ID NO: 327836 - protein, 19 aa, Artificial Sequence
  Description of Artificial Sequence: Synthetic peptide
  Seed: GQEAGLGQVPLIVGILLVL (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVL

SEQ ID NO: 327837 - protein, 19 aa, Artificial Sequence
  Description of Artificial Sequence: Synthetic peptide
  Seed: GQEAGLGQVPLIVGILLVL (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVL

SEQ ID NO: 327838 - protein, 20 aa, Artificial Sequence
  Description of Artificial Sequence: Synthetic peptide
  Seed: GQEAGLGQVPLIVGILLVLM (PMEL_HUMAN)
  Core: AGLGQVPLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQEXGLXQXPLXVGILLVLM

SEQ ID NO: 327839 - protein, 20 aa, Artificial Sequence
  Description of Artificial Sequence: Synthetic peptide
  Seed: GQEAGLGQVPLIVGILLVLM (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVLM

SEQ ID NO: 327840 - protein, 20 aa, Artificial Sequence
  Description of Artificial Sequence: Synthetic peptide
  Seed: GQEAGLGQVPLIVGILLVLM (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVLM

SEQ ID NO: 327841 - protein, 21 aa, Artificial Sequence
  Description of Artificial Sequence: Synthetic peptide
  Seed: GQEAGLGQVPLIVGILLVLMA (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVLMA

SEQ ID NO: 327842 - protein, 21 aa, Artificial Sequence
  Description of Artificial Sequence: Synthetic peptide
  Seed: GQEAGLGQVPLIVGILLVLMA (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVLMA

SEQ ID NO: 327843 - protein, 21 aa, Artificial Sequence
  Description of Artificial Sequence: Synthetic peptide
  Seed: GQEAGLGQVPLIVGILLVLMA (PMEL_HUMAN)
  Core: IVGILLVLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLXVGXLXVLXA

SEQ ID NO: 327844 - protein, 22 aa, Artificial Sequence
  Description of Artificial Sequence: Synthetic peptide
  Seed: GQEAGLGQVPLIVGILLVLMAV (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVLMAV

SEQ ID NO: 327845 - protein, 22 aa, Artificial Sequence
  Description of Artificial Sequence: Synthetic peptide
  Seed: GQEAGLGQVPLIVGILLVLMAV (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVLMAV

SEQ ID NO: 327846 - protein, 22 aa, Artificial Sequence
  Description of Artificial Sequence: Synthetic peptide
  Seed: GQEAGLGQVPLIVGILLVLMAV (PMEL_HUMAN)
  Core: LIVGILLVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPXIVXIXLVXMAV

SEQ ID NO: 327847 - protein, 22 aa, Artificial Sequence
  Description of Artificial Sequence: Synthetic peptide
  Seed: GQEAGLGQVPLIVGILLVLMAV (PMEL_HUMAN)
  Core: IVGILLVLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLXVGXLXVLXAV

SEQ ID NO: 327848 - protein, 23 aa, Artificial Sequence
  Description of Artificial Sequence: Synthetic peptide
  Seed: GQEAGLGQVPLIVGILLVLMAVV (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVLMAVV

SEQ ID NO: 327849 - protein, 23 aa, Artificial Sequence
  Description of Artificial Sequence: Synthetic peptide
  Seed: GQEAGLGQVPLIVGILLVLMAVV (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVLMAVV

SEQ ID NO: 327850 - protein, 23 aa, Artificial Sequence
  Description of Artificial Sequence: Synthetic peptide
  Seed: GQEAGLGQVPLIVGILLVLMAVV (PMEL_HUMAN)
  Core: LIVGILLVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPXIVXIXLVXMAVV

SEQ ID NO: 327851 - protein, 23 aa, Artificial Sequence
  Description of Artificial Sequence: Synthetic peptide
  Seed: GQEAGLGQVPLIVGILLVLMAVV (PMEL_HUMAN)
  Core: IVGILLVLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLXVGXLXVLXAVV

SEQ ID NO: 327852 - protein, 24 aa, Artificial Sequence
  Description of Artificial Sequence: Synthetic peptide
  Seed: GQEAGLGQVPLIVGILLVLMAVVL (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVLMAVVL

SEQ ID NO: 327853 - protein, 24 aa, Artificial Sequence
  Description of Artificial Sequence: Synthetic peptide
  Seed: GQEAGLGQVPLIVGILLVLMAVVL (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVLMAVVL

SEQ ID NO: 327854 - protein, 24 aa, Artificial Sequence
  Description of Artificial Sequence: Synthetic peptide
  Seed: GQEAGLGQVPLIVGILLVLMAVVL (PMEL_HUMAN)
  Core: LIVGILLVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPXIVXIXLVXMAVVL

SEQ ID NO: 327855 - protein, 24 aa, Artificial Sequence
  Description of Artificial Sequence: Synthetic peptide
  Seed: GQEAGLGQVPLIVGILLVLMAVVL (PMEL_HUMAN)
  Core: IVGILLVLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLXVGXLXVLXAVVL

SEQ ID NO: 327856 - protein, 25 aa, Artificial Sequence
  Description of Artificial Sequence: Synthetic peptide
  Seed: GQEAGLGQVPLIVGILLVLMAVVLA (PMEL_HUMAN)
  Core: GLGQVPLIV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQEAXLGXVXLIXGILLVLMAVVLA

SEQ ID NO: 327857 - protein, 25 aa, Artificial Sequence
  Description of Artificial Sequence: Synthetic peptide
  Seed: GQEAGLGQVPLIVGILLVLMAVVLA (PMEL_HUMAN)
  Core: LGQVPLIVG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGXGQXPXIVXILLVLMAVVLA

SEQ ID NO: 327858 - protein, 25 aa, Artificial Sequence
  Description of Artificial Sequence: Synthetic peptide
  Seed: GQEAGLGQVPLIVGILLVLMAVVLA (PMEL_HUMAN)
  Core: LIVGILLVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPXIVXIXLVXMAVVLA

SEQ ID NO: 327859 - protein, 25 aa, Artificial Sequence
  Description of Artificial Sequence: Synthetic peptide
  Seed: GQEAGLGQVPLIVGILLVLMAVVLA (PMEL_HUMAN)
  Core: IVGILLVLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLXVGXLXVLXAVVLA

SEQ ID NO: 327860 - protein, 25 aa, Artificial Sequence
  Description of Artificial Sequence: Synthetic peptide
  Seed: GQEAGLGQVPLIVGILLVLMAVVLA (PMEL_HUMAN)
  Core: ILLVLMAVV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLIVGXLLXLXAVXLA

SEQ ID NO: 327861 - protein, 25 aa, Artificial Sequence
  Description of Artificial Sequence: Synthetic peptide
  Seed: GQEAGLGQVPLIVGILLVLMAVVLA (PMEL_HUMAN)
  Core: LLVLMAVVL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GQEAGLGQVPLIVGIXLVXMXVVXA

SEQ ID NO: 327862 - protein, 13 aa, Artificial Sequence
  Description of Artificial Sequence: Synthetic peptide
  Seed: GQVIWVNNTIING (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNG

SEQ ID NO: 327863 - protein, 13 aa, Artificial Sequence
  Description of Artificial Sequence: Synthetic peptide
  Seed: GQVIWVNNTIING (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXG

SEQ ID NO: 327864 - protein, 14 aa, Artificial Sequence
  Description of Artificial Sequence: Synthetic peptide
  Seed: GQVIWVNNTIINGS (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGS

SEQ ID NO: 327865 - protein, 14 aa, Artificial Sequence
  Description of Artificial Sequence: Synthetic peptide
  Seed: GQVIWVNNTIINGS (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGS

SEQ ID NO: 327866 - protein, 15 aa, Artificial Sequence
  Description of Artificial Sequence: Synthetic peptide
  Seed: GQVIWVNNTIINGSQ (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQ

SEQ ID NO: 327867 - protein, 15 aa, Artificial Sequence
  Description of Artificial Sequence: Synthetic peptide
  Seed: GQVIWVNNTIINGSQ (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQ

SEQ ID NO: 327868 - protein, 15 aa, Artificial Sequence
  Description of Artificial Sequence: Synthetic peptide
  Seed: GQVIWVNNTIINGSQ (PMEL_HUMAN)
  Core: VNNTIINGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWXNNXIXNGXQ

SEQ ID NO: 327869 - protein, 16 aa, Artificial Sequence
  Description of Artificial Sequence: Synthetic peptide
  Seed: GQVIWVNNTIINGSQV (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQV

SEQ ID NO: 327870 - protein, 16 aa, Artificial Sequence
  Description of Artificial Sequence: Synthetic peptide
  Seed: GQVIWVNNTIINGSQV (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQV

SEQ ID NO: 327871 - protein, 16 aa, Artificial Sequence
  Description of Artificial Sequence: Synthetic peptide
  Seed: GQVIWVNNTIINGSQV (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQV

SEQ ID NO: 327872 - protein, 16 aa, Artificial Sequence
  Description of Artificial Sequence: Synthetic peptide
  Seed: GQVIWVNNTIINGSQV (PMEL_HUMAN)
  Core: VNNTIINGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWXNNXIXNGXQV

SEQ ID NO: 327873 - protein, 17 aa, Artificial Sequence
  Description of Artificial Sequence: Synthetic peptide
  Seed: GQVIWVNNTIINGSQVW (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVW

SEQ ID NO: 327874 - protein, 17 aa, Artificial Sequence
  Description of Artificial Sequence: Synthetic peptide
  Seed: GQVIWVNNTIINGSQVW (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVW

SEQ ID NO: 327875 - protein, 17 aa, Artificial Sequence
  Description of Artificial Sequence: Synthetic peptide
  Seed: GQVIWVNNTIINGSQVW (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVW

SEQ ID NO: 327876 - protein, 17 aa, Artificial Sequence
  Description of Artificial Sequence: Synthetic peptide
  Seed: GQVIWVNNTIINGSQVW (PMEL_HUMAN)
  Core: VNNTIINGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWXNNXIXNGXQVW

SEQ ID NO: 327877 - protein, 18 aa, Artificial Sequence
  Description of Artificial Sequence: Synthetic peptide
  Seed: GQVIWVNNTIINGSQVWG (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWG

SEQ ID NO: 327878 - protein, 18 aa, Artificial Sequence
  Description of Artificial Sequence: Synthetic peptide
  Seed: GQVIWVNNTIINGSQVWG (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWG

SEQ ID NO: 327879 - protein, 18 aa, Artificial Sequence
  Description of Artificial Sequence: Synthetic peptide
  Seed: GQVIWVNNTIINGSQVWG (PMEL_HUMAN)
  Core: VNNTIINGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWXNNXIXNGXQVWG

SEQ ID NO: 327880 - protein, 19 aa, Artificial Sequence
  Description of Artificial Sequence: Synthetic peptide
  Seed: GQVIWVNNTIINGSQVWGG (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGG

SEQ ID NO: 327881 - protein, 19 aa, Artificial Sequence
  Description of Artificial Sequence: Synthetic peptide
  Seed: GQVIWVNNTIINGSQVWGG (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGG

SEQ ID NO: 327882 - protein, 19 aa, Artificial Sequence
  Description of Artificial Sequence: Synthetic peptide
  Seed: GQVIWVNNTIINGSQVWGG (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGG

SEQ ID NO: 327883 - protein, 19 aa, Artificial Sequence
  Description of Artificial Sequence: Synthetic peptide
  Seed: GQVIWVNNTIINGSQVWGG (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGX

SEQ ID NO: 327884 - protein, 20 aa, Artificial Sequence
  Description of Artificial Sequence: Synthetic peptide
  Seed: GQVIWVNNTIINGSQVWGGQ (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGGQ

SEQ ID NO: 327885 - protein, 20 aa, Artificial Sequence
  Description of Artificial Sequence: Synthetic peptide
  Seed: GQVIWVNNTIINGSQVWGGQ (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGGQ

SEQ ID NO: 327886 - protein, 20 aa, Artificial Sequence
  Description of Artificial Sequence: Synthetic peptide
  Seed: GQVIWVNNTIINGSQVWGGQ (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGGQ

SEQ ID NO: 327887 - protein, 20 aa, Artificial Sequence
  Description of Artificial Sequence: Synthetic peptide
  Seed: GQVIWVNNTIINGSQVWGGQ (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGXQ

SEQ ID NO: 327888 - protein, 21 aa, Artificial Sequence
  Description of Artificial Sequence: Synthetic peptide
  Seed: GQVIWVNNTIINGSQVWGGQP (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGGQP

SEQ ID NO: 327889 - protein, 21 aa, Artificial Sequence
  Description of Artificial Sequence: Synthetic peptide
  Seed: GQVIWVNNTIINGSQVWGGQP (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGGQP

SEQ ID NO: 327890 - protein, 21 aa, Artificial Sequence
  Description of Artificial Sequence: Synthetic peptide
  Seed: GQVIWVNNTIINGSQVWGGQP (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGGQP

SEQ ID NO: 327891 - protein, 21 aa, Artificial Sequence
  Description of Artificial Sequence: Synthetic peptide
  Seed: GQVIWVNNTIINGSQVWGGQP (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGXQP

SEQ ID NO: 327892 - protein, 22 aa, Artificial Sequence
  Description of Artificial Sequence: Synthetic peptide
  Seed: GQVIWVNNTIINGSQVWGGQPV (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGGQPV

SEQ ID NO: 327893 - protein, 22 aa, Artificial Sequence
  Description of Artificial Sequence: Synthetic peptide
  Seed: GQVIWVNNTIINGSQVWGGQPV (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGGQPV

SEQ ID NO: 327894 - protein, 22 aa, Artificial Sequence
  Description of Artificial Sequence: Synthetic peptide
  Seed: GQVIWVNNTIINGSQVWGGQPV (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGGQPV

SEQ ID NO: 327895 - protein, 22 aa, Artificial Sequence
  Description of Artificial Sequence: Synthetic peptide
  Seed: GQVIWVNNTIINGSQVWGGQPV (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGXQPV

SEQ ID NO: 327896 - protein, 23 aa, Artificial Sequence
  Description of Artificial Sequence: Synthetic peptide
  Seed: GQVIWVNNTIINGSQVWGGQPVY (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGGQPVY

SEQ ID NO: 327897 - protein, 23 aa, Artificial Sequence
  Description of Artificial Sequence: Synthetic peptide
  Seed: GQVIWVNNTIINGSQVWGGQPVY (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGGQPVY

SEQ ID NO: 327898 - protein, 23 aa, Artificial Sequence
  Description of Artificial Sequence: Synthetic peptide
  Seed: GQVIWVNNTIINGSQVWGGQPVY (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGGQPVY

SEQ ID NO: 327899 - protein, 23 aa, Artificial Sequence
  Description of Artificial Sequence: Synthetic peptide
  Seed: GQVIWVNNTIINGSQVWGGQPVY (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGXQPVY

SEQ ID NO: 327900 - protein, 24 aa, Artificial Sequence
  Description of Artificial Sequence: Synthetic peptide
  Seed: GQVIWVNNTIINGSQVWGGQPVYP (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGGQPVYP

SEQ ID NO: 327901 - protein, 24 aa, Artificial Sequence
  Description of Artificial Sequence: Synthetic peptide
  Seed: GQVIWVNNTIINGSQVWGGQPVYP (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGGQPVYP

SEQ ID NO: 327902 - protein, 24 aa, Artificial Sequence
  Description of Artificial Sequence: Synthetic peptide
  Seed: GQVIWVNNTIINGSQVWGGQPVYP (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGGQPVYP

SEQ ID NO: 327903 - protein, 24 aa, Artificial Sequence
  Description of Artificial Sequence: Synthetic peptide
  Seed: GQVIWVNNTIINGSQVWGGQPVYP (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGXQPVYP

SEQ ID NO: 327904 - protein, 24 aa, Artificial Sequence
  Description of Artificial Sequence: Synthetic peptide
  Seed: GQVIWVNNTIINGSQVWGGQPVYP (PMEL_HUMAN)
  Core: SQVWGGQPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIINGXQVXGXQPXYP

SEQ ID NO: 327905 - protein, 25 aa, Artificial Sequence
  Description of Artificial Sequence: Synthetic peptide
  Seed: GQVIWVNNTIINGSQVWGGQPVYPQ (PMEL_HUMAN)
  Core: VIWVNNTII
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXIWXNXTIXNGSQVWGGQPVYPQ

SEQ ID NO: 327906 - protein, 25 aa, Artificial Sequence
  Description of Artificial Sequence: Synthetic peptide
  Seed: GQVIWVNNTIINGSQVWGGQPVYPQ (PMEL_HUMAN)
  Core: IWVNNTIIN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXWVXNXIIXGSQVWGGQPVYPQ

SEQ ID NO: 327907 - protein, 25 aa, Artificial Sequence
  Description of Artificial Sequence: Synthetic peptide
  Seed: GQVIWVNNTIINGSQVWGGQPVYPQ (PMEL_HUMAN)
  Core: WVNNTIING
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVIXVNXTXINXSQVWGGQPVYPQ

SEQ ID NO: 327908 - protein, 25 aa, Artificial Sequence
  Description of Artificial Sequence: Synthetic peptide
  Seed: GQVIWVNNTIINGSQVWGGQPVYPQ (PMEL_HUMAN)
  Core: INGSQVWGG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIXNGXQXWGXQPVYPQ

SEQ ID NO: 327909 - protein, 25 aa, Artificial Sequence
  Description of Artificial Sequence: Synthetic peptide
  Seed: GQVIWVNNTIINGSQVWGGQPVYPQ (PMEL_HUMAN)
  Core: SQVWGGQPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVIWVNNTIINGXQVXGXQPXYPQ

SEQ ID NO: 327910 - protein, 14 aa, Artificial Sequence
  Description of Artificial Sequence: Synthetic peptide
  Seed: GQVPLIVGILLVLM (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXM

SEQ ID NO: 327911 - protein, 14 aa, Artificial Sequence
  Description of Artificial Sequence: Synthetic peptide
  Seed: GQVPLIVGILLVLM (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLX

SEQ ID NO: 327912 - protein, 15 aa, Artificial Sequence
  Description of Artificial Sequence: Synthetic peptide
  Seed: GQVPLIVGILLVLMA (PMEL_HUMAN)
  Core: VPLIVGILL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXPLXVXILXVLMA

SEQ ID NO: 327913 - protein, 15 aa, Artificial Sequence
  Description of Artificial Sequence: Synthetic peptide
  Seed: GQVPLIVGILLVLMA (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXMA

SEQ ID NO: 327914 - protein, 15 aa, Artificial Sequence
  Description of Artificial Sequence: Synthetic peptide
  Seed: GQVPLIVGILLVLMA (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXA

SEQ ID NO: 327915 - protein, 16 aa, Artificial Sequence
  Description of Artificial Sequence: Synthetic peptide
  Seed: GQVPLIVGILLVLMAV (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXMAV

SEQ ID NO: 327916 - protein, 16 aa, Artificial Sequence
  Description of Artificial Sequence: Synthetic peptide
  Seed: GQVPLIVGILLVLMAV (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAV

SEQ ID NO: 327917 - protein, 17 aa, Artificial Sequence
  Description of Artificial Sequence: Synthetic peptide
  Seed: GQVPLIVGILLVLMAVV (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXMAVV

SEQ ID NO: 327918 - protein, 17 aa, Artificial Sequence
  Description of Artificial Sequence: Synthetic peptide
  Seed: GQVPLIVGILLVLMAVV (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVV

SEQ ID NO: 327919 - protein, 18 aa, Artificial Sequence
  Description of Artificial Sequence: Synthetic peptide
  Seed: GQVPLIVGILLVLMAVVL (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVL

SEQ ID NO: 327920 - protein, 19 aa, Artificial Sequence
  Description of Artificial Sequence: Synthetic peptide
  Seed: GQVPLIVGILLVLMAVVLA (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXMAVVLA

SEQ ID NO: 327921 - protein, 19 aa, Artificial Sequence
  Description of Artificial Sequence: Synthetic peptide
  Seed: GQVPLIVGILLVLMAVVLA (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLA

SEQ ID NO: 327922 - protein, 19 aa, Artificial Sequence
  Description of Artificial Sequence: Synthetic peptide
  Seed: GQVPLIVGILLVLMAVVLA (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLA

SEQ ID NO: 327923 - protein, 19 aa, Artificial Sequence
  Description of Artificial Sequence: Synthetic peptide
  Seed: GQVPLIVGILLVLMAVVLA (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXA

SEQ ID NO: 327924 - protein, 20 aa, Artificial Sequence
  Description of Artificial Sequence: Synthetic peptide
  Seed: GQVPLIVGILLVLMAVVLAS (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLAS

SEQ ID NO: 327925 - protein, 20 aa, Artificial Sequence
  Description of Artificial Sequence: Synthetic peptide
  Seed: GQVPLIVGILLVLMAVVLAS (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLAS

SEQ ID NO: 327926 - protein, 20 aa, Artificial Sequence
  Description of Artificial Sequence: Synthetic peptide
  Seed: GQVPLIVGILLVLMAVVLAS (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXAS

SEQ ID NO: 327927 - protein, 20 aa, Artificial Sequence
  Description of Artificial Sequence: Synthetic peptide
  Seed: GQVPLIVGILLVLMAVVLAS (PMEL_HUMAN)
  Core: LVLMAVVLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILXVLXAXVLXS

SEQ ID NO: 327928 - protein, 21 aa, Artificial Sequence
  Description of Artificial Sequence: Synthetic peptide
  Seed: GQVPLIVGILLVLMAVVLASL (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLASL

SEQ ID NO: 327929 - protein, 21 aa, Artificial Sequence
  Description of Artificial Sequence: Synthetic peptide
  Seed: GQVPLIVGILLVLMAVVLASL (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLASL

SEQ ID NO: 327930 - protein, 21 aa, Artificial Sequence
  Description of Artificial Sequence: Synthetic peptide
  Seed: GQVPLIVGILLVLMAVVLASL (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXASL

SEQ ID NO: 327931 - protein, 21 aa, Artificial Sequence
  Description of Artificial Sequence: Synthetic peptide
  Seed: GQVPLIVGILLVLMAVVLASL (PMEL_HUMAN)
  Core: LVLMAVVLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILXVLXAXVLXSL

SEQ ID NO: 327932 - protein, 22 aa, Artificial Sequence
  Description of Artificial Sequence: Synthetic peptide
  Seed: GQVPLIVGILLVLMAVVLASLI (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLASLI

SEQ ID NO: 327933 - protein, 22 aa, Artificial Sequence
  Description of Artificial Sequence: Synthetic peptide
  Seed: GQVPLIVGILLVLMAVVLASLI (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLASLI

SEQ ID NO: 327934 - protein, 22 aa, Artificial Sequence
  Description of Artificial Sequence: Synthetic peptide
  Seed: GQVPLIVGILLVLMAVVLASLI (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXASLI

SEQ ID NO: 327935 - protein, 22 aa, Artificial Sequence
  Description of Artificial Sequence: Synthetic peptide
  Seed: GQVPLIVGILLVLMAVVLASLI (PMEL_HUMAN)
  Core: LVLMAVVLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILXVLXAXVLXSLI

SEQ ID NO: 327936 - protein, 23 aa, Artificial Sequence
  Description of Artificial Sequence: Synthetic peptide
  Seed: GQVPLIVGILLVLMAVVLASLIY (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLASLIY

SEQ ID NO: 327937 - protein, 23 aa, Artificial Sequence
  Description of Artificial Sequence: Synthetic peptide
  Seed: GQVPLIVGILLVLMAVVLASLIY (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLASLIY

SEQ ID NO: 327938 - protein, 23 aa, Artificial Sequence
  Description of Artificial Sequence: Synthetic peptide
  Seed: GQVPLIVGILLVLMAVVLASLIY (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXASLIY

SEQ ID NO: 327939 - protein, 23 aa, Artificial Sequence
  Description of Artificial Sequence: Synthetic peptide
  Seed: GQVPLIVGILLVLMAVVLASLIY (PMEL_HUMAN)
  Core: LVLMAVVLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILXVLXAXVLXSLIY

SEQ ID NO: 327940 - protein, 24 aa, Artificial Sequence
  Description of Artificial Sequence: Synthetic peptide
  Seed: GQVPLIVGILLVLMAVVLASLIYR (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXMAVVLASLIYR

SEQ ID NO: 327941 - protein, 24 aa, Artificial Sequence
  Description of Artificial Sequence: Synthetic peptide
  Seed: GQVPLIVGILLVLMAVVLASLIYR (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLASLIYR

SEQ ID NO: 327942 - protein, 24 aa, Artificial Sequence
  Description of Artificial Sequence: Synthetic peptide
  Seed: GQVPLIVGILLVLMAVVLASLIYR (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLASLIYR

SEQ ID NO: 327943 - protein, 24 aa, Artificial Sequence
  Description of Artificial Sequence: Synthetic peptide
  Seed: GQVPLIVGILLVLMAVVLASLIYR (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXASLIYR

SEQ ID NO: 327944 - protein, 24 aa, Artificial Sequence
  Description of Artificial Sequence: Synthetic peptide
  Seed: GQVPLIVGILLVLMAVVLASLIYR (PMEL_HUMAN)
  Core: VLMAVVLAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLXLMXVXLAXLIYR

SEQ ID NO: 327945 - protein, 24 aa, Artificial Sequence
  Description of Artificial Sequence: Synthetic peptide
  Seed: GQVPLIVGILLVLMAVVLASLIYR (PMEL_HUMAN)
  Core: LMAVVLASL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLVXMAXVXASXIYR

SEQ ID NO: 327946 - protein, 24 aa, Artificial Sequence
  Description of Artificial Sequence: Synthetic peptide
  Seed: GQVPLIVGILLVLMAVVLASLIYR (PMEL_HUMAN)
  Core: MAVVLASLI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLVLXAVXLXSLXYR

SEQ ID NO: 327947 - protein, 25 aa, Artificial Sequence
  Description of Artificial Sequence: Synthetic peptide
  Seed: GQVPLIVGILLVLMAVVLASLIYRR (PMEL_HUMAN)
  Core: LIVGILLVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVPXIVXIXLVXMAVVLASLIYRR

SEQ ID NO: 327948 - protein, 25 aa, Artificial Sequence
  Description of Artificial Sequence: Synthetic peptide
  Seed: GQVPLIVGILLVLMAVVLASLIYRR (PMEL_HUMAN)
  Core: IVGILLVLM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLXVGXLXVLXAVVLASLIYRR

SEQ ID NO: 327949 - protein, 25 aa, Artificial Sequence
  Description of Artificial Sequence: Synthetic peptide
  Seed: GQVPLIVGILLVLMAVVLASLIYRR (PMEL_HUMAN)
  Core: ILLVLMAVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGXLLXLXAVXLASLIYRR

SEQ ID NO: 327950 - protein, 25 aa, Artificial Sequence
  Description of Artificial Sequence: Synthetic peptide
  Seed: GQVPLIVGILLVLMAVVLASLIYRR (PMEL_HUMAN)
  Core: LLVLMAVVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGIXLVXMXVVXASLIYRR

SEQ ID NO: 327951 - protein, 25 aa, Artificial Sequence
  Description of Artificial Sequence: Synthetic peptide
  Seed: GQVPLIVGILLVLMAVVLASLIYRR (PMEL_HUMAN)
  Core: LVLMAVVLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILXVLXAXVLXSLIYRR

SEQ ID NO: 327952 - protein, 25 aa, Artificial Sequence
  Description of Artificial Sequence: Synthetic peptide
  Seed: GQVPLIVGILLVLMAVVLASLIYRR (PMEL_HUMAN)
  Core: VLMAVVLAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLXLMXVXLAXLIYRR

SEQ ID NO: 327953 - protein, 25 aa, Artificial Sequence
  Description of Artificial Sequence: Synthetic peptide
  Seed: GQVPLIVGILLVLMAVVLASLIYRR (PMEL_HUMAN)
  Core: LMAVVLASL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLVXMAXVXASXIYRR

SEQ ID NO: 327954 - protein, 25 aa, Artificial Sequence
  Description of Artificial Sequence: Synthetic peptide
  Seed: GQVPLIVGILLVLMAVVLASLIYRR (PMEL_HUMAN)
  Core: MAVVLASLI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLVLXAVXLXSLXYRR

SEQ ID NO: 327955 - protein, 25 aa, Artificial Sequence
  Description of Artificial Sequence: Synthetic peptide
  Seed: GQVPLIVGILLVLMAVVLASLIYRR (PMEL_HUMAN)
  Core: AVVLASLIY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLVLMXVVXAXLIXRR

SEQ ID NO: 327956 - protein, 25 aa, Artificial Sequence
  Description of Artificial Sequence: Synthetic peptide
  Seed: GQVPLIVGILLVLMAVVLASLIYRR (PMEL_HUMAN)
  Core: VVLASLIYR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GQVPLIVGILLVLMAXVLXSXIYXR

SEQ ID NO: 327957 - protein, 16 aa, Artificial Sequence
  Description of Artificial Sequence: Synthetic peptide
  Seed: GQVPTTEVVGTTPGQA (PMEL_HUMAN)
  Core: PTTEVVGTT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQVXTTXVXGTXPGQA

SEQ ID NO: 327958 - protein, 17 aa, Artificial Sequence
  Description of Artificial Sequence: Synthetic peptide
  Seed: GQVPTTEVVGTTPGQAP (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXP

SEQ ID NO: 327959 - protein, 18 aa, Artificial Sequence
  Description of Artificial Sequence: Synthetic peptide
  Seed: GQVPTTEVVGTTPGQAPT (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPT

SEQ ID NO: 327960 - protein, 19 aa, Artificial Sequence
  Description of Artificial Sequence: Synthetic peptide
  Seed: GQVPTTEVVGTTPGQAPTA (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTA

SEQ ID NO: 327961 - protein, 20 aa, Artificial Sequence
  Description of Artificial Sequence: Synthetic peptide
  Seed: GQVPTTEVVGTTPGQAPTAE (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTAE

SEQ ID NO: 327962 - protein, 21 aa, Artificial Sequence
  Description of Artificial Sequence: Synthetic peptide
  Seed: GQVPTTEVVGTTPGQAPTAEP (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTAEP

SEQ ID NO: 327963 - protein, 22 aa, Artificial Sequence
  Description of Artificial Sequence: Synthetic peptide
  Seed: GQVPTTEVVGTTPGQAPTAEPS (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTAEPS

SEQ ID NO: 327964 - protein, 23 aa, Artificial Sequence
  Description of Artificial Sequence: Synthetic peptide
  Seed: GQVPTTEVVGTTPGQAPTAEPSG (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTAEPSG

SEQ ID NO: 327965 - protein, 24 aa, Artificial Sequence
  Description of Artificial Sequence: Synthetic peptide
  Seed: GQVPTTEVVGTTPGQAPTAEPSGT (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTAEPSGT

SEQ ID NO: 327966 - protein, 25 aa, Artificial Sequence
  Description of Artificial Sequence: Synthetic peptide
  Seed: GQVPTTEVVGTTPGQAPTAEPSGTT (PMEL_HUMAN)
  Core: VVGTTPGQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GQVPTTEXVGXTXGQXPTAEPSGTT

SEQ ID NO: 327967 - protein, 15 aa, Artificial Sequence
  Description of Artificial Sequence: Synthetic peptide
  Seed: GQVSLKVSNDGPTLI (PMEL_HUMAN)
  Core: LKVSNDGPT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVSXKVXNXGPXLI

SEQ ID NO: 327968 - protein, 16 aa, Artificial Sequence
  Description of Artificial Sequence: Synthetic peptide
  Seed: GQVSLKVSNDGPTLIG (PMEL_HUMAN)
  Core: LKVSNDGPT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVSXKVXNXGPXLIG

SEQ ID NO: 327969 - protein, 17 aa, Artificial Sequence
  Description of Artificial Sequence: Synthetic peptide
  Seed: GQVSLKVSNDGPTLIGA (PMEL_HUMAN)
  Core: VSNDGPTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKXSNXGXTLXGA

SEQ ID NO: 327970 - protein, 19 aa, Artificial Sequence
  Description of Artificial Sequence: Synthetic peptide
  Seed: GQVSLKVSNDGPTLIGANA (PMEL_HUMAN)
  Core: VSNDGPTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKXSNXGXTLXGANA

SEQ ID NO: 327971 - protein, 20 aa, Artificial Sequence
  Description of Artificial Sequence: Synthetic peptide
  Seed: GQVSLKVSNDGPTLIGANAS (PMEL_HUMAN)
  Core: LKVSNDGPT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVSXKVXNXGPXLIGANAS

SEQ ID NO: 327972 - protein, 20 aa, Artificial Sequence
  Description of Artificial Sequence: Synthetic peptide
  Seed: GQVSLKVSNDGPTLIGANAS (PMEL_HUMAN)
  Core: VSNDGPTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKXSNXGXTLXGANAS

SEQ ID NO: 327973 - protein, 20 aa, Artificial Sequence
  Description of Artificial Sequence: Synthetic peptide
  Seed: GQVSLKVSNDGPTLIGANAS (PMEL_HUMAN)
  Core: NDGPTLIGA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSXDGXTXIGXNAS

SEQ ID NO: 327974 - protein, 20 aa, Artificial Sequence
  Description of Artificial Sequence: Synthetic peptide
  Seed: GQVSLKVSNDGPTLIGANAS (PMEL_HUMAN)
  Core: PTLIGANAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGXTLXGXNAX

SEQ ID NO: 327975 - protein, 21 aa, Artificial Sequence
  Description of Artificial Sequence: Synthetic peptide
  Seed: GQVSLKVSNDGPTLIGANASF (PMEL_HUMAN)
  Core: VSNDGPTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKXSNXGXTLXGANASF

SEQ ID NO: 327976 - protein, 22 aa, Artificial Sequence
  Description of Artificial Sequence: Synthetic peptide
  Seed: GQVSLKVSNDGPTLIGANASFS (PMEL_HUMAN)
  Core: LKVSNDGPT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVSXKVXNXGPXLIGANASFS

SEQ ID NO: 327977 - protein, 22 aa, Artificial Sequence
  Description of Artificial Sequence: Synthetic peptide
  Seed: GQVSLKVSNDGPTLIGANASFS (PMEL_HUMAN)
  Core: VSNDGPTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKXSNXGXTLXGANASFS

SEQ ID NO: 327978 - protein, 22 aa, Artificial Sequence
  Description of Artificial Sequence: Synthetic peptide
  Seed: GQVSLKVSNDGPTLIGANASFS (PMEL_HUMAN)
  Core: PTLIGANAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGXTLXGXNAXFS

SEQ ID NO: 327979 - protein, 22 aa, Artificial Sequence
  Description of Artificial Sequence: Synthetic peptide
  Seed: GQVSLKVSNDGPTLIGANASFS (PMEL_HUMAN)
  Core: LIGANASFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGPTXIGXNXSFX

SEQ ID NO: 327980 - protein, 23 aa, Artificial Sequence
  Description of Artificial Sequence: Synthetic peptide
  Seed: GQVSLKVSNDGPTLIGANASFSI (PMEL_HUMAN)
  Core: LKVSNDGPT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GQVSXKVXNXGPXLIGANASFSI

SEQ ID NO: 327981 - protein, 23 aa, Artificial Sequence
  Description of Artificial Sequence: Synthetic peptide
  Seed: GQVSLKVSNDGPTLIGANASFSI (PMEL_HUMAN)
  Core: VSNDGPTLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKXSNXGXTLXGANASFSI

SEQ ID NO: 327982 - protein, 23 aa, Artificial Sequence
  Description of Artificial Sequence: Synthetic peptide
  Seed: GQVSLKVSNDGPTLIGANASFSI (PMEL_HUMAN)
  Core: PTLIGANAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGXTLXGXNAXFSI

SEQ ID NO: 327983 - protein, 23 aa, Artificial Sequence
  Description of Artificial Sequence: Synthetic peptide
  Seed: GQVSLKVSNDGPTLIGANASFSI (PMEL_HUMAN)
  Core: LIGANASFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGPTXIGXNXSFXI

SEQ ID NO: 327984 - protein, 24 aa, Artificial Sequence
  Description of Artificial Sequence: Synthetic peptide
  Seed: GQVSLKVSNDGPTLIGANASFSIA (PMEL_HUMAN)
  Core: PTLIGANAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGXTLXGXNAXFSIA

SEQ ID NO: 327985 - protein, 24 aa, Artificial Sequence
  Description of Artificial Sequence: Synthetic peptide
  Seed: GQVSLKVSNDGPTLIGANASFSIA (PMEL_HUMAN)
  Core: LIGANASFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGPTXIGXNXSFXIA

SEQ ID NO: 327986 - protein, 24 aa, Artificial Sequence
  Description of Artificial Sequence: Synthetic peptide
  Seed: GQVSLKVSNDGPTLIGANASFSIA (PMEL_HUMAN)
  Core: IGANASFSI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGPTLXGAXAXFSXA

SEQ ID NO: 327987 - protein, 25 aa, Artificial Sequence
  Description of Artificial Sequence: Synthetic peptide
  Seed: GQVSLKVSNDGPTLIGANASFSIAL (PMEL_HUMAN)
  Core: PTLIGANAS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGXTLXGXNAXFSIAL

SEQ ID NO: 327988 - protein, 25 aa, Artificial Sequence
  Description of Artificial Sequence: Synthetic peptide
  Seed: GQVSLKVSNDGPTLIGANASFSIAL (PMEL_HUMAN)
  Core: LIGANASFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGPTXIGXNXSFXIAL

SEQ ID NO: 327989 - protein, 25 aa, Artificial Sequence
  Description of Artificial Sequence: Synthetic peptide
  Seed: GQVSLKVSNDGPTLIGANASFSIAL (PMEL_HUMAN)
  Core: IGANASFSI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GQVSLKVSNDGPTLXGAXAXFSXAL

SEQ ID NO: 327990 - protein, 13 aa, Artificial Sequence
  Description of Artificial Sequence: Synthetic peptide
  Seed: GQYWQVLGGPVSG (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSG

SEQ ID NO: 327991 - protein, 13 aa, Artificial Sequence
  Description of Artificial Sequence: Synthetic peptide
  Seed: GQYWQVLGGPVSG (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXG

SEQ ID NO: 327992 - protein, 14 aa, Artificial Sequence
  Description of Artificial Sequence: Synthetic peptide
  Seed: GQYWQVLGGPVSGL (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGL

SEQ ID NO: 327993 - protein, 14 aa, Artificial Sequence
  Description of Artificial Sequence: Synthetic peptide
  Seed: GQYWQVLGGPVSGL (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGL

SEQ ID NO: 327994 - protein, 14 aa, Artificial Sequence
  Description of Artificial Sequence: Synthetic peptide
  Seed: GQYWQVLGGPVSGL (PMEL_HUMAN)
  Core: VLGGPVSGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQXLGXPXSGX

SEQ ID NO: 327995 - protein, 15 aa, Artificial Sequence
  Description of Artificial Sequence: Synthetic peptide
  Seed: GQYWQVLGGPVSGLS (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLS

SEQ ID NO: 327996 - protein, 15 aa, Artificial Sequence
  Description of Artificial Sequence: Synthetic peptide
  Seed: GQYWQVLGGPVSGLS (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLS

SEQ ID NO: 327997 - protein, 15 aa, Artificial Sequence
  Description of Artificial Sequence: Synthetic peptide
  Seed: GQYWQVLGGPVSGLS (PMEL_HUMAN)
  Core: VLGGPVSGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQXLGXPXSGXS

SEQ ID NO: 327998 - protein, 16 aa, Artificial Sequence
  Description of Artificial Sequence: Synthetic peptide
  Seed: GQYWQVLGGPVSGLSI (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSI

SEQ ID NO: 327999 - protein, 16 aa, Artificial Sequence
  Description of Artificial Sequence: Synthetic peptide
  Seed: GQYWQVLGGPVSGLSI (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSI

SEQ ID NO: 328000 - protein, 16 aa, Artificial Sequence
  Description of Artificial Sequence: Synthetic peptide
  Seed: GQYWQVLGGPVSGLSI (PMEL_HUMAN)
  Core: VLGGPVSGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQXLGXPXSGXSI

SEQ ID NO: 328001 - protein, 17 aa, Artificial Sequence
  Description of Artificial Sequence: Synthetic peptide
  Seed: GQYWQVLGGPVSGLSIG (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIG

SEQ ID NO: 328002 - protein, 17 aa, Artificial Sequence
  Description of Artificial Sequence: Synthetic peptide
  Seed: GQYWQVLGGPVSGLSIG (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIG

SEQ ID NO: 328003 - protein, 17 aa, Artificial Sequence
  Description of Artificial Sequence: Synthetic peptide
  Seed: GQYWQVLGGPVSGLSIG (PMEL_HUMAN)
  Core: VLGGPVSGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQXLGXPXSGXSIG

SEQ ID NO: 328004 - protein, 18 aa, Artificial Sequence
  Description of Artificial Sequence: Synthetic peptide
  Seed: GQYWQVLGGPVSGLSIGT (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGT

SEQ ID NO: 328005 - protein, 18 aa, Artificial Sequence
  Description of Artificial Sequence: Synthetic peptide
  Seed: GQYWQVLGGPVSGLSIGT (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGT

SEQ ID NO: 328006 - protein, 18 aa, Artificial Sequence
  Description of Artificial Sequence: Synthetic peptide
  Seed: GQYWQVLGGPVSGLSIGT (PMEL_HUMAN)
  Core: VLGGPVSGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQXLGXPXSGXSIGT

SEQ ID NO: 328007 - protein, 19 aa, Artificial Sequence
  Description of Artificial Sequence: Synthetic peptide
  Seed: GQYWQVLGGPVSGLSIGTG (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTG

SEQ ID NO: 328008 - protein, 19 aa, Artificial Sequence
  Description of Artificial Sequence: Synthetic peptide
  Seed: GQYWQVLGGPVSGLSIGTG (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTG

SEQ ID NO: 328009 - protein, 19 aa, Artificial Sequence
  Description of Artificial Sequence: Synthetic peptide
  Seed: GQYWQVLGGPVSGLSIGTG (PMEL_HUMAN)
  Core: VLGGPVSGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQXLGXPXSGXSIGTG

SEQ ID NO: 328010 - protein, 19 aa, Artificial Sequence
  Description of Artificial Sequence: Synthetic peptide
  Seed: GQYWQVLGGPVSGLSIGTG (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXG

SEQ ID NO: 328011 - protein, 20 aa, Artificial Sequence
  Description of Artificial Sequence: Synthetic peptide
  Seed: GQYWQVLGGPVSGLSIGTGR (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTGR

SEQ ID NO: 328012 - protein, 20 aa, Artificial Sequence
  Description of Artificial Sequence: Synthetic peptide
  Seed: GQYWQVLGGPVSGLSIGTGR (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTGR

SEQ ID NO: 328013 - protein, 20 aa, Artificial Sequence
  Description of Artificial Sequence: Synthetic peptide
  Seed: GQYWQVLGGPVSGLSIGTGR (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXGR

SEQ ID NO: 328014 - protein, 20 aa, Artificial Sequence
  Description of Artificial Sequence: Synthetic peptide
  Seed: GQYWQVLGGPVSGLSIGTGR (PMEL_HUMAN)
  Core: VSGLSIGTG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGPXSGXSXGTXR

SEQ ID NO: 328015 - protein, 21 aa, Artificial Sequence
  Description of Artificial Sequence: Synthetic peptide
  Seed: GQYWQVLGGPVSGLSIGTGRA (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTGRA

SEQ ID NO: 328016 - protein, 21 aa, Artificial Sequence
  Description of Artificial Sequence: Synthetic peptide
  Seed: GQYWQVLGGPVSGLSIGTGRA (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTGRA

SEQ ID NO: 328017 - protein, 21 aa, Artificial Sequence
  Description of Artificial Sequence: Synthetic peptide
  Seed: GQYWQVLGGPVSGLSIGTGRA (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXGRA

SEQ ID NO: 328018 - protein, 21 aa, Artificial Sequence
  Description of Artificial Sequence: Synthetic peptide
  Seed: GQYWQVLGGPVSGLSIGTGRA (PMEL_HUMAN)
  Core: VSGLSIGTG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGPXSGXSXGTXRA

SEQ ID NO: 328019 - protein, 22 aa, Artificial Sequence
  Description of Artificial Sequence: Synthetic peptide
  Seed: GQYWQVLGGPVSGLSIGTGRAM (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTGRAM

SEQ ID NO: 328020 - protein, 22 aa, Artificial Sequence
  Description of Artificial Sequence: Synthetic peptide
  Seed: GQYWQVLGGPVSGLSIGTGRAM (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTGRAM

SEQ ID NO: 328021 - protein, 22 aa, Artificial Sequence
  Description of Artificial Sequence: Synthetic peptide
  Seed: GQYWQVLGGPVSGLSIGTGRAM (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXGRAM

SEQ ID NO: 328022 - protein, 22 aa, Artificial Sequence
  Description of Artificial Sequence: Synthetic peptide
  Seed: GQYWQVLGGPVSGLSIGTGRAM (PMEL_HUMAN)
  Core: VSGLSIGTG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGPXSGXSXGTXRAM

SEQ ID NO: 328023 - protein, 23 aa, Artificial Sequence
  Description of Artificial Sequence: Synthetic peptide
  Seed: GQYWQVLGGPVSGLSIGTGRAML (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTGRAML

SEQ ID NO: 328024 - protein, 23 aa, Artificial Sequence
  Description of Artificial Sequence: Synthetic peptide
  Seed: GQYWQVLGGPVSGLSIGTGRAML (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTGRAML

SEQ ID NO: 328025 - protein, 23 aa, Artificial Sequence
  Description of Artificial Sequence: Synthetic peptide
  Seed: GQYWQVLGGPVSGLSIGTGRAML (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXGRAML

SEQ ID NO: 328026 - protein, 23 aa, Artificial Sequence
  Description of Artificial Sequence: Synthetic peptide
  Seed: GQYWQVLGGPVSGLSIGTGRAML (PMEL_HUMAN)
  Core: VSGLSIGTG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGPXSGXSXGTXRAML

SEQ ID NO: 328027 - protein, 24 aa, Artificial Sequence
  Description of Artificial Sequence: Synthetic peptide
  Seed: GQYWQVLGGPVSGLSIGTGRAMLG (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTGRAMLG

SEQ ID NO: 328028 - protein, 24 aa, Artificial Sequence
  Description of Artificial Sequence: Synthetic peptide
  Seed: GQYWQVLGGPVSGLSIGTGRAMLG (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTGRAMLG

SEQ ID NO: 328029 - protein, 24 aa, Artificial Sequence
  Description of Artificial Sequence: Synthetic peptide
  Seed: GQYWQVLGGPVSGLSIGTGRAMLG (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXGRAMLG

SEQ ID NO: 328030 - protein, 24 aa, Artificial Sequence
  Description of Artificial Sequence: Synthetic peptide
  Seed: GQYWQVLGGPVSGLSIGTGRAMLG (PMEL_HUMAN)
  Core: VSGLSIGTG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGPXSGXSXGTXRAMLG

SEQ ID NO: 328031 - protein, 25 aa, Artificial Sequence
  Description of Artificial Sequence: Synthetic peptide
  Seed: GQYWQVLGGPVSGLSIGTGRAMLGT (PMEL_HUMAN)
  Core: YWQVLGGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GQXWQXLXGPXSGLSIGTGRAMLGT

SEQ ID NO: 328032 - protein, 25 aa, Artificial Sequence
  Description of Artificial Sequence: Synthetic peptide
  Seed: GQYWQVLGGPVSGLSIGTGRAMLGT (PMEL_HUMAN)
  Core: WQVLGGPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GQYXQVXGXPVXGLSIGTGRAMLGT

SEQ ID NO: 328033 - protein, 25 aa, Artificial Sequence
  Description of Artificial Sequence: Synthetic peptide
  Seed: GQYWQVLGGPVSGLSIGTGRAMLGT (PMEL_HUMAN)
  Core: PVSGLSIGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGXVSXLXIGXGRAMLGT

SEQ ID NO: 328034 - protein, 25 aa, Artificial Sequence
  Description of Artificial Sequence: Synthetic peptide
  Seed: GQYWQVLGGPVSGLSIGTGRAMLGT (PMEL_HUMAN)
  Core: VSGLSIGTG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GQYWQVLGGPXSGXSXGTXRAMLGT

SEQ ID NO: 328035 - protein, 14 aa, Artificial Sequence
  Description of Artificial Sequence: Synthetic peptide
  Seed: GRAMLGTHTMEVTV (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTV

SEQ ID NO: 328036 - protein, 15 aa, Artificial Sequence
  Description of Artificial Sequence: Synthetic peptide
  Seed: GRAMLGTHTMEVTVY (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVY

SEQ ID NO: 328037 - protein, 15 aa, Artificial Sequence
  Description of Artificial Sequence: Synthetic peptide
  Seed: GRAMLGTHTMEVTVY (PMEL_HUMAN)
  Core: LGTHTMEVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GRAMXGTXTXEVXVY

SEQ ID NO: 328038 - protein, 16 aa, Artificial Sequence
  Description of Artificial Sequence: Synthetic peptide
  Seed: GRAMLGTHTMEVTVYH (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYH

SEQ ID NO: 328039 - protein, 16 aa, Artificial Sequence
  Description of Artificial Sequence: Synthetic peptide
  Seed: GRAMLGTHTMEVTVYH (PMEL_HUMAN)
  Core: LGTHTMEVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GRAMXGTXTXEVXVYH

SEQ ID NO: 328040 - protein, 16 aa, Artificial Sequence
  Description of Artificial Sequence: Synthetic peptide
  Seed: GRAMLGTHTMEVTVYH (PMEL_HUMAN)
  Core: THTMEVTVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGXHTXEXTVXH

SEQ ID NO: 328041 - protein, 17 aa, Artificial Sequence
  Description of Artificial Sequence: Synthetic peptide
  Seed: GRAMLGTHTMEVTVYHR (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHR

SEQ ID NO: 328042 - protein, 17 aa, Artificial Sequence
  Description of Artificial Sequence: Synthetic peptide
  Seed: GRAMLGTHTMEVTVYHR (PMEL_HUMAN)
  Core: LGTHTMEVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GRAMXGTXTXEVXVYHR

SEQ ID NO: 328043 - protein, 17 aa, Artificial Sequence
  Description of Artificial Sequence: Synthetic peptide
  Seed: GRAMLGTHTMEVTVYHR (PMEL_HUMAN)
  Core: THTMEVTVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGXHTXEXTVXHR

SEQ ID NO: 328044 - protein, 18 aa, Artificial Sequence
  Description of Artificial Sequence: Synthetic peptide
  Seed: GRAMLGTHTMEVTVYHRR (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRR

SEQ ID NO: 328045 - protein, 18 aa, Artificial Sequence
  Description of Artificial Sequence: Synthetic peptide
  Seed: GRAMLGTHTMEVTVYHRR (PMEL_HUMAN)
  Core: LGTHTMEVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GRAMXGTXTXEVXVYHRR

SEQ ID NO: 328046 - protein, 19 aa, Artificial Sequence
  Description of Artificial Sequence: Synthetic peptide
  Seed: GRAMLGTHTMEVTVYHRRG (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRG

SEQ ID NO: 328047 - protein, 19 aa, Artificial Sequence
  Description of Artificial Sequence: Synthetic peptide
  Seed: GRAMLGTHTMEVTVYHRRG (PMEL_HUMAN)
  Core: LGTHTMEVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GRAMXGTXTXEVXVYHRRG

SEQ ID NO: 328048 - protein, 19 aa, Artificial Sequence
  Description of Artificial Sequence: Synthetic peptide
  Seed: GRAMLGTHTMEVTVYHRRG (PMEL_HUMAN)
  Core: THTMEVTVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGXHTXEXTVXHRRG

SEQ ID NO: 328049 - protein, 19 aa, Artificial Sequence
  Description of Artificial Sequence: Synthetic peptide
  Seed: GRAMLGTHTMEVTVYHRRG (PMEL_HUMAN)
  Core: HTMEVTVYH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTXTMXVXVYXRRG

SEQ ID NO: 328050 - protein, 19 aa, Artificial Sequence
  Description of Artificial Sequence: Synthetic peptide
  Seed: GRAMLGTHTMEVTVYHRRG (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXG

SEQ ID NO: 328051 - protein, 20 aa, Artificial Sequence
  Description of Artificial Sequence: Synthetic peptide
  Seed: GRAMLGTHTMEVTVYHRRGS (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRGS

SEQ ID NO: 328052 - protein, 20 aa, Artificial Sequence
  Description of Artificial Sequence: Synthetic peptide
  Seed: GRAMLGTHTMEVTVYHRRGS (PMEL_HUMAN)
  Core: LGTHTMEVT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GRAMXGTXTXEVXVYHRRGS

SEQ ID NO: 328053 - protein, 20 aa, Artificial Sequence
  Description of Artificial Sequence: Synthetic peptide
  Seed: GRAMLGTHTMEVTVYHRRGS (PMEL_HUMAN)
  Core: THTMEVTVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGXHTXEXTVXHRRGS

SEQ ID NO: 328054 - protein, 20 aa, Artificial Sequence
  Description of Artificial Sequence: Synthetic peptide
  Seed: GRAMLGTHTMEVTVYHRRGS (PMEL_HUMAN)
  Core: HTMEVTVYH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTXTMXVXVYXRRGS

SEQ ID NO: 328055 - protein, 20 aa, Artificial Sequence
  Description of Artificial Sequence: Synthetic peptide
  Seed: GRAMLGTHTMEVTVYHRRGS (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXGS

SEQ ID NO: 328056 - protein, 20 aa, Artificial Sequence
  Description of Artificial Sequence: Synthetic peptide
  Seed: GRAMLGTHTMEVTVYHRRGS (PMEL_HUMAN)
  Core: VTVYHRRGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEXTVXHXRGX

SEQ ID NO: 328057 - protein, 21 aa, Artificial Sequence
  Description of Artificial Sequence: Synthetic peptide
  Seed: GRAMLGTHTMEVTVYHRRGSR (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRGSR

SEQ ID NO: 328058 - protein, 21 aa, Artificial Sequence
  Description of Artificial Sequence: Synthetic peptide
  Seed: GRAMLGTHTMEVTVYHRRGSR (PMEL_HUMAN)
  Core: HTMEVTVYH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTXTMXVXVYXRRGSR

SEQ ID NO: 328059 - protein, 21 aa, Artificial Sequence
  Description of Artificial Sequence: Synthetic peptide
  Seed: GRAMLGTHTMEVTVYHRRGSR (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXGSR

SEQ ID NO: 328060 - protein, 21 aa, Artificial Sequence
  Description of Artificial Sequence: Synthetic peptide
  Seed: GRAMLGTHTMEVTVYHRRGSR (PMEL_HUMAN)
  Core: VTVYHRRGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEXTVXHXRGXR

SEQ ID NO: 328061 - protein, 22 aa, Artificial Sequence
  Description of Artificial Sequence: Synthetic peptide
  Seed: GRAMLGTHTMEVTVYHRRGSRS (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRGSRS

SEQ ID NO: 328062 - protein, 22 aa, Artificial Sequence
  Description of Artificial Sequence: Synthetic peptide
  Seed: GRAMLGTHTMEVTVYHRRGSRS (PMEL_HUMAN)
  Core: HTMEVTVYH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTXTMXVXVYXRRGSRS

SEQ ID NO: 328063 - protein, 22 aa, Artificial Sequence
  Description of Artificial Sequence: Synthetic peptide
  Seed: GRAMLGTHTMEVTVYHRRGSRS (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXGSRS

SEQ ID NO: 328064 - protein, 22 aa, Artificial Sequence
  Description of Artificial Sequence: Synthetic peptide
  Seed: GRAMLGTHTMEVTVYHRRGSRS (PMEL_HUMAN)
  Core: VTVYHRRGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEXTVXHXRGXRS

SEQ ID NO: 328065 - protein, 23 aa, Artificial Sequence
  Description of Artificial Sequence: Synthetic peptide
  Seed: GRAMLGTHTMEVTVYHRRGSRSY (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRGSRSY

SEQ ID NO: 328066 - protein, 23 aa, Artificial Sequence
  Description of Artificial Sequence: Synthetic peptide
  Seed: GRAMLGTHTMEVTVYHRRGSRSY (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXGSRSY

SEQ ID NO: 328067 - protein, 23 aa, Artificial Sequence
  Description of Artificial Sequence: Synthetic peptide
  Seed: GRAMLGTHTMEVTVYHRRGSRSY (PMEL_HUMAN)
  Core: VTVYHRRGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEXTVXHXRGXRSY

SEQ ID NO: 328068 - protein, 24 aa, Artificial Sequence
  Description of Artificial Sequence: Synthetic peptide
  Seed: GRAMLGTHTMEVTVYHRRGSRSYV (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRGSRSYV

SEQ ID NO: 328069 - protein, 24 aa, Artificial Sequence
  Description of Artificial Sequence: Synthetic peptide
  Seed: GRAMLGTHTMEVTVYHRRGSRSYV (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXGSRSYV

SEQ ID NO: 328070 - protein, 24 aa, Artificial Sequence
  Description of Artificial Sequence: Synthetic peptide
  Seed: GRAMLGTHTMEVTVYHRRGSRSYV (PMEL_HUMAN)
  Core: VTVYHRRGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEXTVXHXRGXRSYV

SEQ ID NO: 328071 - protein, 25 aa, Artificial Sequence
  Description of Artificial Sequence: Synthetic peptide
  Seed: GRAMLGTHTMEVTVYHRRGSRSYVP (PMEL_HUMAN)
  Core: MLGTHTMEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GRAXLGXHXMEXTVYHRRGSRSYVP

SEQ ID NO: 328072 - protein, 25 aa, Artificial Sequence
  Description of Artificial Sequence: Synthetic peptide
  Seed: GRAMLGTHTMEVTVYHRRGSRSYVP (PMEL_HUMAN)
  Core: THTMEVTVY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGXHTXEXTVXHRRGSRSYVP

SEQ ID NO: 328073 - protein, 25 aa, Artificial Sequence
  Description of Artificial Sequence: Synthetic peptide
  Seed: GRAMLGTHTMEVTVYHRRGSRSYVP (PMEL_HUMAN)
  Core: MEVTVYHRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTXEVXVXHRXGSRSYVP

SEQ ID NO: 328074 - protein, 25 aa, Artificial Sequence
  Description of Artificial Sequence: Synthetic peptide
  Seed: GRAMLGTHTMEVTVYHRRGSRSYVP (PMEL_HUMAN)
  Core: VTVYHRRGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEXTVXHXRGXRSYVP

SEQ ID NO: 328075 - protein, 25 aa, Artificial Sequence
  Description of Artificial Sequence: Synthetic peptide
  Seed: GRAMLGTHTMEVTVYHRRGSRSYVP (PMEL_HUMAN)
  Core: YHRRGSRSY
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GRAMLGTHTMEVTVXHRXGXRSXVP

SEQ ID NO: 328076 - protein, 13 aa, Artificial Sequence
  Description of Artificial Sequence: Synthetic peptide
  Seed: GSFSVTLDIVQGI (PMEL_HUMAN)
  Core: FSVTLDIVQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSVXLXIVXGI

SEQ ID NO: 328077 - protein, 14 aa, Artificial Sequence
  Description of Artificial Sequence: Synthetic peptide
  Seed: GSFSVTLDIVQGIE (PMEL_HUMAN)
  Core: FSVTLDIVQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSVXLXIVXGIE

SEQ ID NO: 328078 - protein, 14 aa, Artificial Sequence
  Description of Artificial Sequence: Synthetic peptide
  Seed: GSFSVTLDIVQGIE (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXE

SEQ ID NO: 328079 - protein, 15 aa, Artificial Sequence
  Description of Artificial Sequence: Synthetic peptide
  Seed: GSFSVTLDIVQGIES (PMEL_HUMAN)
  Core: FSVTLDIVQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSVXLXIVXGIES

SEQ ID NO: 328080 - protein, 15 aa, Artificial Sequence
  Description of Artificial Sequence: Synthetic peptide
  Seed: GSFSVTLDIVQGIES (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXES

SEQ ID NO: 328081 - protein, 16 aa, Artificial Sequence
  Description of Artificial Sequence: Synthetic peptide
  Seed: GSFSVTLDIVQGIESA (PMEL_HUMAN)
  Core: FSVTLDIVQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSVXLXIVXGIESA

SEQ ID NO: 328082 - protein, 16 aa, Artificial Sequence
  Description of Artificial Sequence: Synthetic peptide
  Seed: GSFSVTLDIVQGIESA (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXESA

SEQ ID NO: 328083 - protein, 16 aa, Artificial Sequence
  Description of Artificial Sequence: Synthetic peptide
  Seed: GSFSVTLDIVQGIESA (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXA

SEQ ID NO: 328084 - protein, 17 aa, Artificial Sequence
  Description of Artificial Sequence: Synthetic peptide
  Seed: GSFSVTLDIVQGIESAE (PMEL_HUMAN)
  Core: FSVTLDIVQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSVXLXIVXGIESAE

SEQ ID NO: 328085 - protein, 17 aa, Artificial Sequence
  Description of Artificial Sequence: Synthetic peptide
  Seed: GSFSVTLDIVQGIESAE (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXESAE

SEQ ID NO: 328086 - protein, 17 aa, Artificial Sequence
  Description of Artificial Sequence: Synthetic peptide
  Seed: GSFSVTLDIVQGIESAE (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAE

SEQ ID NO: 328087 - protein, 18 aa, Artificial Sequence
  Description of Artificial Sequence: Synthetic peptide
  Seed: GSFSVTLDIVQGIESAEI (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXESAEI

SEQ ID NO: 328088 - protein, 18 aa, Artificial Sequence
  Description of Artificial Sequence: Synthetic peptide
  Seed: GSFSVTLDIVQGIESAEI (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEI

SEQ ID NO: 328089 - protein, 18 aa, Artificial Sequence
  Description of Artificial Sequence: Synthetic peptide
  Seed: GSFSVTLDIVQGIESAEI (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEX

SEQ ID NO: 328090 - protein, 19 aa, Artificial Sequence
  Description of Artificial Sequence: Synthetic peptide
  Seed: GSFSVTLDIVQGIESAEIL (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXESAEIL

SEQ ID NO: 328091 - protein, 19 aa, Artificial Sequence
  Description of Artificial Sequence: Synthetic peptide
  Seed: GSFSVTLDIVQGIESAEIL (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEIL

SEQ ID NO: 328092 - protein, 19 aa, Artificial Sequence
  Description of Artificial Sequence: Synthetic peptide
  Seed: GSFSVTLDIVQGIESAEIL (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXL

SEQ ID NO: 328093 - protein, 20 aa, Artificial Sequence
  Description of Artificial Sequence: Synthetic peptide
  Seed: GSFSVTLDIVQGIESAEILQ (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXESAEILQ

SEQ ID NO: 328094 - protein, 20 aa, Artificial Sequence
  Description of Artificial Sequence: Synthetic peptide
  Seed: GSFSVTLDIVQGIESAEILQ (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEILQ

SEQ ID NO: 328095 - protein, 20 aa, Artificial Sequence
  Description of Artificial Sequence: Synthetic peptide
  Seed: GSFSVTLDIVQGIESAEILQ (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXLQ

SEQ ID NO: 328096 - protein, 21 aa, Artificial Sequence
  Description of Artificial Sequence: Synthetic peptide
  Seed: GSFSVTLDIVQGIESAEILQA (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEILQA

SEQ ID NO: 328097 - protein, 21 aa, Artificial Sequence
  Description of Artificial Sequence: Synthetic peptide
  Seed: GSFSVTLDIVQGIESAEILQA (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXLQA

SEQ ID NO: 328098 - protein, 21 aa, Artificial Sequence
  Description of Artificial Sequence: Synthetic peptide
  Seed: GSFSVTLDIVQGIESAEILQA (PMEL_HUMAN)
  Core: IESAEILQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIVQGXESXEXLQX

SEQ ID NO: 328099 - protein, 22 aa, Artificial Sequence
  Description of Artificial Sequence: Synthetic peptide
  Seed: GSFSVTLDIVQGIESAEILQAV (PMEL_HUMAN)
  Core: VTLDIVQGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSFSXTLXIXQGXESAEILQAV

SEQ ID NO: 328100 - protein, 22 aa, Artificial Sequence
  Description of Artificial Sequence: Synthetic peptide
  Seed: GSFSVTLDIVQGIESAEILQAV (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEILQAV

SEQ ID NO: 328101 - protein, 22 aa, Artificial Sequence
  Description of Artificial Sequence: Synthetic peptide
  Seed: GSFSVTLDIVQGIESAEILQAV (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXLQAV

SEQ ID NO: 328102 - protein, 22 aa, Artificial Sequence
  Description of Artificial Sequence: Synthetic peptide
  Seed: GSFSVTLDIVQGIESAEILQAV (PMEL_HUMAN)
  Core: IESAEILQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIVQGXESXEXLQXV

SEQ ID NO: 328103 - protein, 23 aa, Artificial Sequence
  Description of Artificial Sequence: Synthetic peptide
  Seed: GSFSVTLDIVQGIESAEILQAVP (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEILQAVP

SEQ ID NO: 328104 - protein, 23 aa, Artificial Sequence
  Description of Artificial Sequence: Synthetic peptide
  Seed: GSFSVTLDIVQGIESAEILQAVP (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXLQAVP

SEQ ID NO: 328105 - protein, 23 aa, Artificial Sequence
  Description of Artificial Sequence: Synthetic peptide
  Seed: GSFSVTLDIVQGIESAEILQAVP (PMEL_HUMAN)
  Core: IESAEILQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIVQGXESXEXLQXVP

SEQ ID NO: 328106 - protein, 24 aa, Artificial Sequence
  Description of Artificial Sequence: Synthetic peptide
  Seed: GSFSVTLDIVQGIESAEILQAVPS (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEILQAVPS

SEQ ID NO: 328107 - protein, 24 aa, Artificial Sequence
  Description of Artificial Sequence: Synthetic peptide
  Seed: GSFSVTLDIVQGIESAEILQAVPS (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXLQAVPS

SEQ ID NO: 328108 - protein, 24 aa, Artificial Sequence
  Description of Artificial Sequence: Synthetic peptide
  Seed: GSFSVTLDIVQGIESAEILQAVPS (PMEL_HUMAN)
  Core: IESAEILQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIVQGXESXEXLQXVPS

SEQ ID NO: 328109 - protein, 25 aa, Artificial Sequence
  Description of Artificial Sequence: Synthetic peptide
  Seed: GSFSVTLDIVQGIESAEILQAVPSG (PMEL_HUMAN)
  Core: LDIVQGIES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTXDIXQXIEXAEILQAVPSG

SEQ ID NO: 328110 - protein, 25 aa, Artificial Sequence
  Description of Artificial Sequence: Synthetic peptide
  Seed: GSFSVTLDIVQGIESAEILQAVPSG (PMEL_HUMAN)
  Core: VQGIESAEI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIXQGXEXAEXLQAVPSG

SEQ ID NO: 328111 - protein, 25 aa, Artificial Sequence
  Description of Artificial Sequence: Synthetic peptide
  Seed: GSFSVTLDIVQGIESAEILQAVPSG (PMEL_HUMAN)
  Core: IESAEILQA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIVQGXESXEXLQXVPSG

SEQ ID NO: 328112 - protein, 25 aa, Artificial Sequence
  Description of Artificial Sequence: Synthetic peptide
  Seed: GSFSVTLDIVQGIESAEILQAVPSG (PMEL_HUMAN)
  Core: ESAEILQAV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GSFSVTLDIVQGIXSAXIXQAXPSG

SEQ ID NO: 328113 - protein, 14 aa, Artificial Sequence
  Description of Artificial Sequence: Synthetic peptide
  Seed: GSGTYCLNVSLADT (PMEL_HUMAN)
  Core: TYCLNVSLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSGXYCXNXSLXDT

SEQ ID NO: 328114 - protein, 14 aa, Artificial Sequence
  Description of Artificial Sequence: Synthetic peptide
  Seed: GSGTYCLNVSLADT (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXT

SEQ ID NO: 328115 - protein, 15 aa, Artificial Sequence
  Description of Artificial Sequence: Synthetic peptide
  Seed: GSGTYCLNVSLADTN (PMEL_HUMAN)
  Core: TYCLNVSLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSGXYCXNXSLXDTN

SEQ ID NO: 328116 - protein, 15 aa, Artificial Sequence
  Description of Artificial Sequence: Synthetic peptide
  Seed: GSGTYCLNVSLADTN (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTN

SEQ ID NO: 328117 - protein, 16 aa, Artificial Sequence
  Description of Artificial Sequence: Synthetic peptide
  Seed: GSGTYCLNVSLADTNS (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNS

SEQ ID NO: 328118 - protein, 16 aa, Artificial Sequence
  Description of Artificial Sequence: Synthetic peptide
  Seed: GSGTYCLNVSLADTNS (PMEL_HUMAN)
  Core: CLNVSLADT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYXLNXSXADXNS

SEQ ID NO: 328119 - protein, 17 aa, Artificial Sequence
  Description of Artificial Sequence: Synthetic peptide
  Seed: GSGTYCLNVSLADTNSL (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSL

SEQ ID NO: 328120 - protein, 18 aa, Artificial Sequence
  Description of Artificial Sequence: Synthetic peptide
  Seed: GSGTYCLNVSLADTNSLA (PMEL_HUMAN)
  Core: LNVSLADTN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCXNVXLXDTXSLA

SEQ ID NO: 328121 - protein, 19 aa, Artificial Sequence
  Description of Artificial Sequence: Synthetic peptide
  Seed: GSGTYCLNVSLADTNSLAV (PMEL_HUMAN)
  Core: TYCLNVSLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSGXYCXNXSLXDTNSLAV

SEQ ID NO: 328122 - protein, 19 aa, Artificial Sequence
  Description of Artificial Sequence: Synthetic peptide
  Seed: GSGTYCLNVSLADTNSLAV (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAV

SEQ ID NO: 328123 - protein, 19 aa, Artificial Sequence
  Description of Artificial Sequence: Synthetic peptide
  Seed: GSGTYCLNVSLADTNSLAV (PMEL_HUMAN)
  Core: LNVSLADTN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCXNVXLXDTXSLAV

SEQ ID NO: 328124 - protein, 19 aa, Artificial Sequence
  Description of Artificial Sequence: Synthetic peptide
  Seed: GSGTYCLNVSLADTNSLAV (PMEL_HUMAN)
  Core: VSLADTNSL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNXSLXDXNSXAV

SEQ ID NO: 328125 - protein, 19 aa, Artificial Sequence
  Description of Artificial Sequence: Synthetic peptide
  Seed: GSGTYCLNVSLADTNSLAV (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAX

SEQ ID NO: 328126 - protein, 20 aa, Artificial Sequence
  Description of Artificial Sequence: Synthetic peptide
  Seed: GSGTYCLNVSLADTNSLAVV (PMEL_HUMAN)
  Core: TYCLNVSLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSGXYCXNXSLXDTNSLAVV

SEQ ID NO: 328127 - protein, 20 aa, Artificial Sequence
  Description of Artificial Sequence: Synthetic peptide
  Seed: GSGTYCLNVSLADTNSLAVV (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAVV

SEQ ID NO: 328128 - protein, 20 aa, Artificial Sequence
  Description of Artificial Sequence: Synthetic peptide
  Seed: GSGTYCLNVSLADTNSLAVV (PMEL_HUMAN)
  Core: VSLADTNSL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNXSLXDXNSXAVV

SEQ ID NO: 328129 - protein, 20 aa, Artificial Sequence
  Description of Artificial Sequence: Synthetic peptide
  Seed: GSGTYCLNVSLADTNSLAVV (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAXV

SEQ ID NO: 328130 - protein, 21 aa, Artificial Sequence
  Description of Artificial Sequence: Synthetic peptide
  Seed: GSGTYCLNVSLADTNSLAVVS (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAVVS

SEQ ID NO: 328131 - protein, 21 aa, Artificial Sequence
  Description of Artificial Sequence: Synthetic peptide
  Seed: GSGTYCLNVSLADTNSLAVVS (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAXVS

SEQ ID NO: 328132 - protein, 22 aa, Artificial Sequence
  Description of Artificial Sequence: Synthetic peptide
  Seed: GSGTYCLNVSLADTNSLAVVST (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAVVST

SEQ ID NO: 328133 - protein, 22 aa, Artificial Sequence
  Description of Artificial Sequence: Synthetic peptide
  Seed: GSGTYCLNVSLADTNSLAVVST (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAXVST

SEQ ID NO: 328134 - protein, 23 aa, Artificial Sequence
  Description of Artificial Sequence: Synthetic peptide
  Seed: GSGTYCLNVSLADTNSLAVVSTQ (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAVVSTQ

SEQ ID NO: 328135 - protein, 23 aa, Artificial Sequence
  Description of Artificial Sequence: Synthetic peptide
  Seed: GSGTYCLNVSLADTNSLAVVSTQ (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAXVSTQ

SEQ ID NO: 328136 - protein, 23 aa, Artificial Sequence
  Description of Artificial Sequence: Synthetic peptide
  Seed: GSGTYCLNVSLADTNSLAVVSTQ (PMEL_HUMAN)
  Core: DTNSLAVVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSLAXTNXLXVVXTQ

SEQ ID NO: 328137 - protein, 24 aa, Artificial Sequence
  Description of Artificial Sequence: Synthetic peptide
  Seed: GSGTYCLNVSLADTNSLAVVSTQL (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAVVSTQL

SEQ ID NO: 328138 - protein, 24 aa, Artificial Sequence
  Description of Artificial Sequence: Synthetic peptide
  Seed: GSGTYCLNVSLADTNSLAVVSTQL (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAXVSTQL

SEQ ID NO: 328139 - protein, 24 aa, Artificial Sequence
  Description of Artificial Sequence: Synthetic peptide
  Seed: GSGTYCLNVSLADTNSLAVVSTQL (PMEL_HUMAN)
  Core: DTNSLAVVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSLAXTNXLXVVXTQL

SEQ ID NO: 328140 - protein, 24 aa, Artificial Sequence
  Description of Artificial Sequence: Synthetic peptide
  Seed: GSGTYCLNVSLADTNSLAVVSTQL (PMEL_HUMAN)
  Core: NSLAVVSTQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSLADTXSLXVXSTXL

SEQ ID NO: 328141 - protein, 25 aa, Artificial Sequence
  Description of Artificial Sequence: Synthetic peptide
  Seed: GSGTYCLNVSLADTNSLAVVSTQLI (PMEL_HUMAN)
  Core: YCLNVSLAD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSGTXCLXVXLAXTNSLAVVSTQLI

SEQ ID NO: 328142 - protein, 25 aa, Artificial Sequence
  Description of Artificial Sequence: Synthetic peptide
  Seed: GSGTYCLNVSLADTNSLAVVSTQLI (PMEL_HUMAN)
  Core: LADTNSLAV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSXADXNXLAXVSTQLI

SEQ ID NO: 328143 - protein, 25 aa, Artificial Sequence
  Description of Artificial Sequence: Synthetic peptide
  Seed: GSGTYCLNVSLADTNSLAVVSTQLI (PMEL_HUMAN)
  Core: DTNSLAVVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSLAXTNXLXVVXTQLI

SEQ ID NO: 328144 - protein, 25 aa, Artificial Sequence
  Description of Artificial Sequence: Synthetic peptide
  Seed: GSGTYCLNVSLADTNSLAVVSTQLI (PMEL_HUMAN)
  Core: NSLAVVSTQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GSGTYCLNVSLADTXSLXVXSTXLI

SEQ ID NO: 328145 - protein, 15 aa, Artificial Sequence
  Description of Artificial Sequence: Synthetic peptide
  Seed: GSLGPLLDGTATLRL (PMEL_HUMAN)
  Core: LGPLLDGTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXGPXLXGTXTLRL

SEQ ID NO: 328146 - protein, 15 aa, Artificial Sequence
  Description of Artificial Sequence: Synthetic peptide
  Seed: GSLGPLLDGTATLRL (PMEL_HUMAN)
  Core: LLDGTATLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPXLDXTXTLXL

SEQ ID NO: 328147 - protein, 15 aa, Artificial Sequence
  Description of Artificial Sequence: Synthetic peptide
  Seed: GSLGPLLDGTATLRL (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRX

SEQ ID NO: 328148 - protein, 16 aa, Artificial Sequence
  Description of Artificial Sequence: Synthetic peptide
  Seed: GSLGPLLDGTATLRLV (PMEL_HUMAN)
  Core: LGPLLDGTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXGPXLXGTXTLRLV

SEQ ID NO: 328149 - protein, 16 aa, Artificial Sequence
  Description of Artificial Sequence: Synthetic peptide
  Seed: GSLGPLLDGTATLRLV (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXV

SEQ ID NO: 328150 - protein, 17 aa, Artificial Sequence
  Description of Artificial Sequence: Synthetic peptide
  Seed: GSLGPLLDGTATLRLVK (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVK

SEQ ID NO: 328151 - protein, 18 aa, Artificial Sequence
  Description of Artificial Sequence: Synthetic peptide
  Seed: GSLGPLLDGTATLRLVKR (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKR

SEQ ID NO: 328152 - protein, 19 aa, Artificial Sequence
  Description of Artificial Sequence: Synthetic peptide
  Seed: GSLGPLLDGTATLRLVKRQ (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQ

SEQ ID NO: 328153 - protein, 19 aa, Artificial Sequence
  Description of Artificial Sequence: Synthetic peptide
  Seed: GSLGPLLDGTATLRLVKRQ (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQ

SEQ ID NO: 328154 - protein, 20 aa, Artificial Sequence
  Description of Artificial Sequence: Synthetic peptide
  Seed: GSLGPLLDGTATLRLVKRQV (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQV

SEQ ID NO: 328155 - protein, 20 aa, Artificial Sequence
  Description of Artificial Sequence: Synthetic peptide
  Seed: GSLGPLLDGTATLRLVKRQV (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQV

SEQ ID NO: 328156 - protein, 21 aa, Artificial Sequence
  Description of Artificial Sequence: Synthetic peptide
  Seed: GSLGPLLDGTATLRLVKRQVP (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQVP

SEQ ID NO: 328157 - protein, 21 aa, Artificial Sequence
  Description of Artificial Sequence: Synthetic peptide
  Seed: GSLGPLLDGTATLRLVKRQVP (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQVP

SEQ ID NO: 328158 - protein, 21 aa, Artificial Sequence
  Description of Artificial Sequence: Synthetic peptide
  Seed: GSLGPLLDGTATLRLVKRQVP (PMEL_HUMAN)
  Core: LRLVKRQVP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTATXRLXKXQVX

SEQ ID NO: 328159 - protein, 22 aa, Artificial Sequence
  Description of Artificial Sequence: Synthetic peptide
  Seed: GSLGPLLDGTATLRLVKRQVPL (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQVPL

SEQ ID NO: 328160 - protein, 22 aa, Artificial Sequence
  Description of Artificial Sequence: Synthetic peptide
  Seed: GSLGPLLDGTATLRLVKRQVPL (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQVPL

SEQ ID NO: 328161 - protein, 22 aa, Artificial Sequence
  Description of Artificial Sequence: Synthetic peptide
  Seed: GSLGPLLDGTATLRLVKRQVPL (PMEL_HUMAN)
  Core: LRLVKRQVP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTATXRLXKXQVXL

SEQ ID NO: 328162 - protein, 23 aa, Artificial Sequence
  Description of Artificial Sequence: Synthetic peptide
  Seed: GSLGPLLDGTATLRLVKRQVPLD (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQVPLD

SEQ ID NO: 328163 - protein, 23 aa, Artificial Sequence
  Description of Artificial Sequence: Synthetic peptide
  Seed: GSLGPLLDGTATLRLVKRQVPLD (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQVPLD

SEQ ID NO: 328164 - protein, 23 aa, Artificial Sequence
  Description of Artificial Sequence: Synthetic peptide
  Seed: GSLGPLLDGTATLRLVKRQVPLD (PMEL_HUMAN)
  Core: TLRLVKRQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTAXLRXVXRQXPLD

SEQ ID NO: 328165 - protein, 23 aa, Artificial Sequence
  Description of Artificial Sequence: Synthetic peptide
  Seed: GSLGPLLDGTATLRLVKRQVPLD (PMEL_HUMAN)
  Core: LRLVKRQVP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTATXRLXKXQVXLD

SEQ ID NO: 328166 - protein, 24 aa, Artificial Sequence
  Description of Artificial Sequence: Synthetic peptide
  Seed: GSLGPLLDGTATLRLVKRQVPLDC (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQVPLDC

SEQ ID NO: 328167 - protein, 24 aa, Artificial Sequence
  Description of Artificial Sequence: Synthetic peptide
  Seed: GSLGPLLDGTATLRLVKRQVPLDC (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQVPLDC

SEQ ID NO: 328168 - protein, 24 aa, Artificial Sequence
  Description of Artificial Sequence: Synthetic peptide
  Seed: GSLGPLLDGTATLRLVKRQVPLDC (PMEL_HUMAN)
  Core: TLRLVKRQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTAXLRXVXRQXPLDC

SEQ ID NO: 328169 - protein, 24 aa, Artificial Sequence
  Description of Artificial Sequence: Synthetic peptide
  Seed: GSLGPLLDGTATLRLVKRQVPLDC (PMEL_HUMAN)
  Core: LRLVKRQVP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTATXRLXKXQVXLDC

SEQ ID NO: 328170 - protein, 25 aa, Artificial Sequence
  Description of Artificial Sequence: Synthetic peptide
  Seed: GSLGPLLDGTATLRLVKRQVPLDCV (PMEL_HUMAN)
  Core: LDGTATLRL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLXDGXAXLRXVKRQVPLDCV

SEQ ID NO: 328171 - protein, 25 aa, Artificial Sequence
  Description of Artificial Sequence: Synthetic peptide
  Seed: GSLGPLLDGTATLRLVKRQVPLDCV (PMEL_HUMAN)
  Core: DGTATLRLV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLXGTXTXRLXKRQVPLDCV

SEQ ID NO: 328172 - protein, 25 aa, Artificial Sequence
  Description of Artificial Sequence: Synthetic peptide
  Seed: GSLGPLLDGTATLRLVKRQVPLDCV (PMEL_HUMAN)
  Core: TATLRLVKR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGXATXRXVKXQVPLDCV

SEQ ID NO: 328173 - protein, 25 aa, Artificial Sequence
  Description of Artificial Sequence: Synthetic peptide
  Seed: GSLGPLLDGTATLRLVKRQVPLDCV (PMEL_HUMAN)
  Core: TLRLVKRQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTAXLRXVXRQXPLDCV

SEQ ID NO: 328174 - protein, 25 aa, Artificial Sequence
  Description of Artificial Sequence: Synthetic peptide
  Seed: GSLGPLLDGTATLRLVKRQVPLDCV (PMEL_HUMAN)
  Core: LRLVKRQVP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTATXRLXKXQVXLDCV

SEQ ID NO: 328175 - protein, 25 aa, Artificial Sequence
  Description of Artificial Sequence: Synthetic peptide
  Seed: GSLGPLLDGTATLRLVKRQVPLDCV (PMEL_HUMAN)
  Core: LVKRQVPLD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GSLGPLLDGTATLRXVKXQXPLXCV

SEQ ID NO: 328176 - protein, 15 aa, Artificial Sequence
  Description of Artificial Sequence: Synthetic peptide
  Seed: GSQKVLPDGQVIWVN (PMEL_HUMAN)
  Core: VLPDGQVIW
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSQKXLPXGXVIXVN

SEQ ID NO: 328177 - protein, 19 aa, Artificial Sequence
  Description of Artificial Sequence: Synthetic peptide
  Seed: GSQKVLPDGQVIWVNNTII (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXI

SEQ ID NO: 328178 - protein, 19 aa, Artificial Sequence
  Description of Artificial Sequence: Synthetic peptide
  Seed: GSQKVLPDGQVIWVNNTII (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIX

SEQ ID NO: 328179 - protein, 20 aa, Artificial Sequence
  Description of Artificial Sequence: Synthetic peptide
  Seed: GSQKVLPDGQVIWVNNTIIN (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXIN

SEQ ID NO: 328180 - protein, 20 aa, Artificial Sequence
  Description of Artificial Sequence: Synthetic peptide
  Seed: GSQKVLPDGQVIWVNNTIIN (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIXN

SEQ ID NO: 328181 - protein, 20 aa, Artificial Sequence
  Description of Artificial Sequence: Synthetic peptide
  Seed: GSQKVLPDGQVIWVNNTIIN (PMEL_HUMAN)
  Core: IWVNNTIIN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVXWVXNXIIX

SEQ ID NO: 328182 - protein, 21 aa, Artificial Sequence
  Description of Artificial Sequence: Synthetic peptide
  Seed: GSQKVLPDGQVIWVNNTIING (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXING

SEQ ID NO: 328183 - protein, 21 aa, Artificial Sequence
  Description of Artificial Sequence: Synthetic peptide
  Seed: GSQKVLPDGQVIWVNNTIING (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIXNG

SEQ ID NO: 328184 - protein, 21 aa, Artificial Sequence
  Description of Artificial Sequence: Synthetic peptide
  Seed: GSQKVLPDGQVIWVNNTIING (PMEL_HUMAN)
  Core: IWVNNTIIN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVXWVXNXIIXG

SEQ ID NO: 328185 - protein, 22 aa, Artificial Sequence
  Description of Artificial Sequence: Synthetic peptide
  Seed: GSQKVLPDGQVIWVNNTIINGS (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXINGS

SEQ ID NO: 328186 - protein, 22 aa, Artificial Sequence
  Description of Artificial Sequence: Synthetic peptide
  Seed: GSQKVLPDGQVIWVNNTIINGS (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIXNGS

SEQ ID NO: 328187 - protein, 22 aa, Artificial Sequence
  Description of Artificial Sequence: Synthetic peptide
  Seed: GSQKVLPDGQVIWVNNTIINGS (PMEL_HUMAN)
  Core: IWVNNTIIN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVXWVXNXIIXGS

SEQ ID NO: 328188 - protein, 23 aa, Artificial Sequence
  Description of Artificial Sequence: Synthetic peptide
  Seed: GSQKVLPDGQVIWVNNTIINGSQ (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXINGSQ

SEQ ID NO: 328189 - protein, 23 aa, Artificial Sequence
  Description of Artificial Sequence: Synthetic peptide
  Seed: GSQKVLPDGQVIWVNNTIINGSQ (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIXNGSQ

SEQ ID NO: 328190 - protein, 23 aa, Artificial Sequence
  Description of Artificial Sequence: Synthetic peptide
  Seed: GSQKVLPDGQVIWVNNTIINGSQ (PMEL_HUMAN)
  Core: IWVNNTIIN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVXWVXNXIIXGSQ

SEQ ID NO: 328191 - protein, 24 aa, Artificial Sequence
  Description of Artificial Sequence: Synthetic peptide
  Seed: GSQKVLPDGQVIWVNNTIINGSQV (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXINGSQV

SEQ ID NO: 328192 - protein, 24 aa, Artificial Sequence
  Description of Artificial Sequence: Synthetic peptide
  Seed: GSQKVLPDGQVIWVNNTIINGSQV (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIXNGSQV

SEQ ID NO: 328193 - protein, 24 aa, Artificial Sequence
  Description of Artificial Sequence: Synthetic peptide
  Seed: GSQKVLPDGQVIWVNNTIINGSQV (PMEL_HUMAN)
  Core: IWVNNTIIN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVXWVXNXIIXGSQV

SEQ ID NO: 328194 - protein, 25 aa, Artificial Sequence
  Description of Artificial Sequence: Synthetic peptide
  Seed: GSQKVLPDGQVIWVNNTIINGSQVW (PMEL_HUMAN)
  Core: QVIWVNNTI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGXVIXVXNTXINGSQVW

SEQ ID NO: 328195 - protein, 25 aa, Artificial Sequence
  Description of Artificial Sequence: Synthetic peptide
  Seed: GSQKVLPDGQVIWVNNTIINGSQVW (PMEL_HUMAN)
  Core: VIWVNNTII
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQXIWXNXTIXNGSQVW

SEQ ID NO: 328196 - protein, 25 aa, Artificial Sequence
  Description of Artificial Sequence: Synthetic peptide
  Seed: GSQKVLPDGQVIWVNNTIINGSQVW (PMEL_HUMAN)
  Core: IWVNNTIIN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVXWVXNXIIXGSQVW

SEQ ID NO: 328197 - protein, 25 aa, Artificial Sequence
  Description of Artificial Sequence: Synthetic peptide
  Seed: GSQKVLPDGQVIWVNNTIINGSQVW (PMEL_HUMAN)
  Core: VNNTIINGS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GSQKVLPDGQVIWXNNXIXNGXQVW

SEQ ID NO: 328198 - protein, 13 aa, Artificial Sequence
  Description of Artificial Sequence: Synthetic peptide
  Seed: GSQVWGGQPVYPQ (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQ

SEQ ID NO: 328199 - protein, 14 aa, Artificial Sequence
  Description of Artificial Sequence: Synthetic peptide
  Seed: GSQVWGGQPVYPQE (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQE

SEQ ID NO: 328200 - protein, 15 aa, Artificial Sequence
  Description of Artificial Sequence: Synthetic peptide
  Seed: GSQVWGGQPVYPQET (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQET

SEQ ID NO: 328201 - protein, 16 aa, Artificial Sequence
  Description of Artificial Sequence: Synthetic peptide
  Seed: GSQVWGGQPVYPQETD (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETD

SEQ ID NO: 328202 - protein, 17 aa, Artificial Sequence
  Description of Artificial Sequence: Synthetic peptide
  Seed: GSQVWGGQPVYPQETDD (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDD

SEQ ID NO: 328203 - protein, 18 aa, Artificial Sequence
  Description of Artificial Sequence: Synthetic peptide
  Seed: GSQVWGGQPVYPQETDDA (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDA

SEQ ID NO: 328204 - protein, 19 aa, Artificial Sequence
  Description of Artificial Sequence: Synthetic peptide
  Seed: GSQVWGGQPVYPQETDDAC (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDAC

SEQ ID NO: 328205 - protein, 20 aa, Artificial Sequence
  Description of Artificial Sequence: Synthetic peptide
  Seed: GSQVWGGQPVYPQETDDACI (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDACI

SEQ ID NO: 328206 - protein, 21 aa, Artificial Sequence
  Description of Artificial Sequence: Synthetic peptide
  Seed: GSQVWGGQPVYPQETDDACIF (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDACIF

SEQ ID NO: 328207 - protein, 22 aa, Artificial Sequence
  Description of Artificial Sequence: Synthetic peptide
  Seed: GSQVWGGQPVYPQETDDACIFP (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDACIFP

SEQ ID NO: 328208 - protein, 23 aa, Artificial Sequence
  Description of Artificial Sequence: Synthetic peptide
  Seed: GSQVWGGQPVYPQETDDACIFPD (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDACIFPD

SEQ ID NO: 328209 - protein, 24 aa, Artificial Sequence
  Description of Artificial Sequence: Synthetic peptide
  Seed: GSQVWGGQPVYPQETDDACIFPDG (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDACIFPDG

SEQ ID NO: 328210 - protein, 25 aa, Artificial Sequence
  Description of Artificial Sequence: Synthetic peptide
  Seed: GSQVWGGQPVYPQETDDACIFPDGG (PMEL_HUMAN)
  Core: VWGGQPVYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSQXWGXQXVYXQETDDACIFPDGG

SEQ ID NO: 328211 - protein, 13 aa, Artificial Sequence
  Description of Artificial Sequence: Synthetic peptide
  Seed: GSRSYVPLAHSSS (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSS

SEQ ID NO: 328212 - protein, 14 aa, Artificial Sequence
  Description of Artificial Sequence: Synthetic peptide
  Seed: GSRSYVPLAHSSSA (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSA

SEQ ID NO: 328213 - protein, 14 aa, Artificial Sequence
  Description of Artificial Sequence: Synthetic peptide
  Seed: GSRSYVPLAHSSSA (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXA

SEQ ID NO: 328214 - protein, 15 aa, Artificial Sequence
  Description of Artificial Sequence: Synthetic peptide
  Seed: GSRSYVPLAHSSSAF (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAF

SEQ ID NO: 328215 - protein, 15 aa, Artificial Sequence
  Description of Artificial Sequence: Synthetic peptide
  Seed: GSRSYVPLAHSSSAF (PMEL_HUMAN)
  Core: SYVPLAHSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSRXYVXLXHSXSAF

SEQ ID NO: 328216 - protein, 15 aa, Artificial Sequence
  Description of Artificial Sequence: Synthetic peptide
  Seed: GSRSYVPLAHSSSAF (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAF

SEQ ID NO: 328217 - protein, 15 aa, Artificial Sequence
  Description of Artificial Sequence: Synthetic peptide
  Seed: GSRSYVPLAHSSSAF (PMEL_HUMAN)
  Core: VPLAHSSSA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYXPLXHXSSXF

SEQ ID NO: 328218 - protein, 16 aa, Artificial Sequence
  Description of Artificial Sequence: Synthetic peptide
  Seed: GSRSYVPLAHSSSAFT (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFT

SEQ ID NO: 328219 - protein, 16 aa, Artificial Sequence
  Description of Artificial Sequence: Synthetic peptide
  Seed: GSRSYVPLAHSSSAFT (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFT

SEQ ID NO: 328220 - protein, 16 aa, Artificial Sequence
  Description of Artificial Sequence: Synthetic peptide
  Seed: GSRSYVPLAHSSSAFT (PMEL_HUMAN)
  Core: VPLAHSSSA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYXPLXHXSSXFT

SEQ ID NO: 328221 - protein, 16 aa, Artificial Sequence
  Description of Artificial Sequence: Synthetic peptide
  Seed: GSRSYVPLAHSSSAFT (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFX

SEQ ID NO: 328222 - protein, 17 aa, Artificial Sequence
  Description of Artificial Sequence: Synthetic peptide
  Seed: GSRSYVPLAHSSSAFTI (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTI

SEQ ID NO: 328223 - protein, 17 aa, Artificial Sequence
  Description of Artificial Sequence: Synthetic peptide
  Seed: GSRSYVPLAHSSSAFTI (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTI

SEQ ID NO: 328224 - protein, 17 aa, Artificial Sequence
  Description of Artificial Sequence: Synthetic peptide
  Seed: GSRSYVPLAHSSSAFTI (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXI

SEQ ID NO: 328225 - protein, 17 aa, Artificial Sequence
  Description of Artificial Sequence: Synthetic peptide
  Seed: GSRSYVPLAHSSSAFTI (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTX

SEQ ID NO: 328226 - protein, 18 aa, Artificial Sequence
  Description of Artificial Sequence: Synthetic peptide
  Seed: GSRSYVPLAHSSSAFTIT (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTIT

SEQ ID NO: 328227 - protein, 18 aa, Artificial Sequence
  Description of Artificial Sequence: Synthetic peptide
  Seed: GSRSYVPLAHSSSAFTIT (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTIT

SEQ ID NO: 328228 - protein, 18 aa, Artificial Sequence
  Description of Artificial Sequence: Synthetic peptide
  Seed: GSRSYVPLAHSSSAFTIT (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXIT

SEQ ID NO: 328229 - protein, 18 aa, Artificial Sequence
  Description of Artificial Sequence: Synthetic peptide
  Seed: GSRSYVPLAHSSSAFTIT (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXT

SEQ ID NO: 328230 - protein, 19 aa, Artificial Sequence
  Description of Artificial Sequence: Synthetic peptide
  Seed: GSRSYVPLAHSSSAFTITD (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITD

SEQ ID NO: 328231 - protein, 19 aa, Artificial Sequence
  Description of Artificial Sequence: Synthetic peptide
  Seed: GSRSYVPLAHSSSAFTITD (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITD

SEQ ID NO: 328232 - protein, 19 aa, Artificial Sequence
  Description of Artificial Sequence: Synthetic peptide
  Seed: GSRSYVPLAHSSSAFTITD (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITD

SEQ ID NO: 328233 - protein, 19 aa, Artificial Sequence
  Description of Artificial Sequence: Synthetic peptide
  Seed: GSRSYVPLAHSSSAFTITD (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTD

SEQ ID NO: 328234 - protein, 20 aa, Artificial Sequence
  Description of Artificial Sequence: Synthetic peptide
  Seed: GSRSYVPLAHSSSAFTITDQ (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITDQ

SEQ ID NO: 328235 - protein, 20 aa, Artificial Sequence
  Description of Artificial Sequence: Synthetic peptide
  Seed: GSRSYVPLAHSSSAFTITDQ (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITDQ

SEQ ID NO: 328236 - protein, 20 aa, Artificial Sequence
  Description of Artificial Sequence: Synthetic peptide
  Seed: GSRSYVPLAHSSSAFTITDQ (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITDQ

SEQ ID NO: 328237 - protein, 20 aa, Artificial Sequence
  Description of Artificial Sequence: Synthetic peptide
  Seed: GSRSYVPLAHSSSAFTITDQ (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTDQ

SEQ ID NO: 328238 - protein, 20 aa, Artificial Sequence
  Description of Artificial Sequence: Synthetic peptide
  Seed: GSRSYVPLAHSSSAFTITDQ (PMEL_HUMAN)
  Core: HSSSAFTIT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAXSSXAXTIXDQ

SEQ ID NO: 328239 - protein, 21 aa, Artificial Sequence
  Description of Artificial Sequence: Synthetic peptide
  Seed: GSRSYVPLAHSSSAFTITDQV (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITDQV

SEQ ID NO: 328240 - protein, 21 aa, Artificial Sequence
  Description of Artificial Sequence: Synthetic peptide
  Seed: GSRSYVPLAHSSSAFTITDQV (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITDQV

SEQ ID NO: 328241 - protein, 21 aa, Artificial Sequence
  Description of Artificial Sequence: Synthetic peptide
  Seed: GSRSYVPLAHSSSAFTITDQV (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITDQV

SEQ ID NO: 328242 - protein, 21 aa, Artificial Sequence
  Description of Artificial Sequence: Synthetic peptide
  Seed: GSRSYVPLAHSSSAFTITDQV (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTDQV

SEQ ID NO: 328243 - protein, 22 aa, Artificial Sequence
  Description of Artificial Sequence: Synthetic peptide
  Seed: GSRSYVPLAHSSSAFTITDQVP (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITDQVP

SEQ ID NO: 328244 - protein, 22 aa, Artificial Sequence
  Description of Artificial Sequence: Synthetic peptide
  Seed: GSRSYVPLAHSSSAFTITDQVP (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITDQVP

SEQ ID NO: 328245 - protein, 22 aa, Artificial Sequence
  Description of Artificial Sequence: Synthetic peptide
  Seed: GSRSYVPLAHSSSAFTITDQVP (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITDQVP

SEQ ID NO: 328246 - protein, 22 aa, Artificial Sequence
  Description of Artificial Sequence: Synthetic peptide
  Seed: GSRSYVPLAHSSSAFTITDQVP (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTDQVP

SEQ ID NO: 328247 - protein, 22 aa, Artificial Sequence
  Description of Artificial Sequence: Synthetic peptide
  Seed: GSRSYVPLAHSSSAFTITDQVP (PMEL_HUMAN)
  Core: SSSAFTITD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHXSSXFXITXQVP

SEQ ID NO: 328248 - protein, 22 aa, Artificial Sequence
  Description of Artificial Sequence: Synthetic peptide
  Seed: GSRSYVPLAHSSSAFTITDQVP (PMEL_HUMAN)
  Core: SSAFTITDQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSXSAXTXTDXVP

SEQ ID NO: 328249 - protein, 23 aa, Artificial Sequence
  Description of Artificial Sequence: Synthetic peptide
  Seed: GSRSYVPLAHSSSAFTITDQVPF (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITDQVPF

SEQ ID NO: 328250 - protein, 23 aa, Artificial Sequence
  Description of Artificial Sequence: Synthetic peptide
  Seed: GSRSYVPLAHSSSAFTITDQVPF (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITDQVPF

SEQ ID NO: 328251 - protein, 23 aa, Artificial Sequence
  Description of Artificial Sequence: Synthetic peptide
  Seed: GSRSYVPLAHSSSAFTITDQVPF (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITDQVPF

SEQ ID NO: 328252 - protein, 23 aa, Artificial Sequence
  Description of Artificial Sequence: Synthetic peptide
  Seed: GSRSYVPLAHSSSAFTITDQVPF (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTDQVPF

SEQ ID NO: 328253 - protein, 23 aa, Artificial Sequence
  Description of Artificial Sequence: Synthetic peptide
  Seed: GSRSYVPLAHSSSAFTITDQVPF (PMEL_HUMAN)
  Core: HSSSAFTIT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAXSSXAXTIXDQVPF

SEQ ID NO: 328254 - protein, 23 aa, Artificial Sequence
  Description of Artificial Sequence: Synthetic peptide
  Seed: GSRSYVPLAHSSSAFTITDQVPF (PMEL_HUMAN)
  Core: SSAFTITDQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSXSAXTXTDXVPF

SEQ ID NO: 328255 - protein, 23 aa, Artificial Sequence
  Description of Artificial Sequence: Synthetic peptide
  Seed: GSRSYVPLAHSSSAFTITDQVPF (PMEL_HUMAN)
  Core: SAFTITDQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSSXAFXIXDQXPF

SEQ ID NO: 328256 - protein, 24 aa, Artificial Sequence
  Description of Artificial Sequence: Synthetic peptide
  Seed: GSRSYVPLAHSSSAFTITDQVPFS (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITDQVPFS

SEQ ID NO: 328257 - protein, 24 aa, Artificial Sequence
  Description of Artificial Sequence: Synthetic peptide
  Seed: GSRSYVPLAHSSSAFTITDQVPFS (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITDQVPFS

SEQ ID NO: 328258 - protein, 24 aa, Artificial Sequence
  Description of Artificial Sequence: Synthetic peptide
  Seed: GSRSYVPLAHSSSAFTITDQVPFS (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITDQVPFS

SEQ ID NO: 328259 - protein, 24 aa, Artificial Sequence
  Description of Artificial Sequence: Synthetic peptide
  Seed: GSRSYVPLAHSSSAFTITDQVPFS (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTDQVPFS

SEQ ID NO: 328260 - protein, 24 aa, Artificial Sequence
  Description of Artificial Sequence: Synthetic peptide
  Seed: GSRSYVPLAHSSSAFTITDQVPFS (PMEL_HUMAN)
  Core: HSSSAFTIT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAXSSXAXTIXDQVPFS

SEQ ID NO: 328261 - protein, 24 aa, Artificial Sequence
  Description of Artificial Sequence: Synthetic peptide
  Seed: GSRSYVPLAHSSSAFTITDQVPFS (PMEL_HUMAN)
  Core: SSAFTITDQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSXSAXTXTDXVPFS

SEQ ID NO: 328262 - protein, 24 aa, Artificial Sequence
  Description of Artificial Sequence: Synthetic peptide
  Seed: GSRSYVPLAHSSSAFTITDQVPFS (PMEL_HUMAN)
  Core: SAFTITDQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSSXAFXIXDQXPFS

SEQ ID NO: 328263 - protein, 24 aa, Artificial Sequence
  Description of Artificial Sequence: Synthetic peptide
  Seed: GSRSYVPLAHSSSAFTITDQVPFS (PMEL_HUMAN)
  Core: FTITDQVPF
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSSSAXTIXDXVPXS

SEQ ID NO: 328264 - protein, 25 aa, Artificial Sequence
  Description of Artificial Sequence: Synthetic peptide
  Seed: GSRSYVPLAHSSSAFTITDQVPFSV (PMEL_HUMAN)
  Core: RSYVPLAHS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSYXPXAHXSSAFTITDQVPFSV

SEQ ID NO: 328265 - protein, 25 aa, Artificial Sequence
  Description of Artificial Sequence: Synthetic peptide
  Seed: GSRSYVPLAHSSSAFTITDQVPFSV (PMEL_HUMAN)
  Core: YVPLAHSSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GSRSXVPXAXSSXAFTITDQVPFSV

SEQ ID NO: 328266 - protein, 25 aa, Artificial Sequence
  Description of Artificial Sequence: Synthetic peptide
  Seed: GSRSYVPLAHSSSAFTITDQVPFSV (PMEL_HUMAN)
  Core: LAHSSSAFT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPXAHXSXAFXITDQVPFSV

SEQ ID NO: 328267 - protein, 25 aa, Artificial Sequence
  Description of Artificial Sequence: Synthetic peptide
  Seed: GSRSYVPLAHSSSAFTITDQVPFSV (PMEL_HUMAN)
  Core: AHSSSAFTI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLXHSXSXFTXTDQVPFSV

SEQ ID NO: 328268 - protein, 25 aa, Artificial Sequence
  Description of Artificial Sequence: Synthetic peptide
  Seed: GSRSYVPLAHSSSAFTITDQVPFSV (PMEL_HUMAN)
  Core: HSSSAFTIT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAXSSXAXTIXDQVPFSV

SEQ ID NO: 328269 - protein, 25 aa, Artificial Sequence
  Description of Artificial Sequence: Synthetic peptide
  Seed: GSRSYVPLAHSSSAFTITDQVPFSV (PMEL_HUMAN)
  Core: SSAFTITDQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSXSAXTXTDXVPFSV

SEQ ID NO: 328270 - protein, 25 aa, Artificial Sequence
  Description of Artificial Sequence: Synthetic peptide
  Seed: GSRSYVPLAHSSSAFTITDQVPFSV (PMEL_HUMAN)
  Core: SAFTITDQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSSXAFXIXDQXPFSV

SEQ ID NO: 328271 - protein, 25 aa, Artificial Sequence
  Description of Artificial Sequence: Synthetic peptide
  Seed: GSRSYVPLAHSSSAFTITDQVPFSV (PMEL_HUMAN)
  Core: FTITDQVPF
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GSRSYVPLAHSSSAXTIXDXVPXSV

SEQ ID NO: 328272 - protein, 15 aa, Artificial Sequence
  Description of Artificial Sequence: Synthetic peptide
  Seed: GSWSQKRSFVYVWKT (PMEL_HUMAN)
  Core: WSQKRSFVY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSQXRXFVXVWKT

SEQ ID NO: 328273 - protein, 15 aa, Artificial Sequence
  Description of Artificial Sequence: Synthetic peptide
  Seed: GSWSQKRSFVYVWKT (PMEL_HUMAN)
  Core: SQKRSFVYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GSWXQKXSXVYXWKT

SEQ ID NO: 328274 - protein, 15 aa, Artificial Sequence
  Description of Artificial Sequence: Synthetic peptide
  Seed: GSWSQKRSFVYVWKT (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKX

SEQ ID NO: 328275 - protein, 16 aa, Artificial Sequence
  Description of Artificial Sequence: Synthetic peptide
  Seed: GSWSQKRSFVYVWKTW (PMEL_HUMAN)
  Core: WSQKRSFVY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSQXRXFVXVWKTW

SEQ ID NO: 328276 - protein, 16 aa, Artificial Sequence
  Description of Artificial Sequence: Synthetic peptide
  Seed: GSWSQKRSFVYVWKTW (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXW

SEQ ID NO: 328277 - protein, 17 aa, Artificial Sequence
  Description of Artificial Sequence: Synthetic peptide
  Seed: GSWSQKRSFVYVWKTWG (PMEL_HUMAN)
  Core: WSQKRSFVY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSQXRXFVXVWKTWG

SEQ ID NO: 328278 - protein, 17 aa, Artificial Sequence
  Description of Artificial Sequence: Synthetic peptide
  Seed: GSWSQKRSFVYVWKTWG (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWG

SEQ ID NO: 328279 - protein, 17 aa, Artificial Sequence
  Description of Artificial Sequence: Synthetic peptide
  Seed: GSWSQKRSFVYVWKTWG (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWX

SEQ ID NO: 328280 - protein, 18 aa, Artificial Sequence
  Description of Artificial Sequence: Synthetic peptide
  Seed: GSWSQKRSFVYVWKTWGQ (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQ

SEQ ID NO: 328281 - protein, 18 aa, Artificial Sequence
  Description of Artificial Sequence: Synthetic peptide
  Seed: GSWSQKRSFVYVWKTWGQ (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQ

SEQ ID NO: 328282 - protein, 19 aa, Artificial Sequence
  Description of Artificial Sequence: Synthetic peptide
  Seed: GSWSQKRSFVYVWKTWGQY (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQY

SEQ ID NO: 328283 - protein, 19 aa, Artificial Sequence
  Description of Artificial Sequence: Synthetic peptide
  Seed: GSWSQKRSFVYVWKTWGQY (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQY

SEQ ID NO: 328284 - protein, 19 aa, Artificial Sequence
  Description of Artificial Sequence: Synthetic peptide
  Seed: GSWSQKRSFVYVWKTWGQY (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXY

SEQ ID NO: 328285 - protein, 19 aa, Artificial Sequence
  Description of Artificial Sequence: Synthetic peptide
  Seed: GSWSQKRSFVYVWKTWGQY (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQX

SEQ ID NO: 328286 - protein, 20 aa, Artificial Sequence
  Description of Artificial Sequence: Synthetic peptide
  Seed: GSWSQKRSFVYVWKTWGQYW (PMEL_HUMAN)
  Core: WSQKRSFVY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GSXSQXRXFVXVWKTWGQYW

SEQ ID NO: 328287 - protein, 20 aa, Artificial Sequence
  Description of Artificial Sequence: Synthetic peptide
  Seed: GSWSQKRSFVYVWKTWGQYW (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQYW

SEQ ID NO: 328288 - protein, 20 aa, Artificial Sequence
  Description of Artificial Sequence: Synthetic peptide
  Seed: GSWSQKRSFVYVWKTWGQYW (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQYW

SEQ ID NO: 328289 - protein, 20 aa, Artificial Sequence
  Description of Artificial Sequence: Synthetic peptide
  Seed: GSWSQKRSFVYVWKTWGQYW (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXYW

SEQ ID NO: 328290 - protein, 20 aa, Artificial Sequence
  Description of Artificial Sequence: Synthetic peptide
  Seed: GSWSQKRSFVYVWKTWGQYW (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQXW

SEQ ID NO: 328291 - protein, 21 aa, Artificial Sequence
  Description of Artificial Sequence: Synthetic peptide
  Seed: GSWSQKRSFVYVWKTWGQYWQ (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQYWQ

SEQ ID NO: 328292 - protein, 21 aa, Artificial Sequence
  Description of Artificial Sequence: Synthetic peptide
  Seed: GSWSQKRSFVYVWKTWGQYWQ (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQYWQ

SEQ ID NO: 328293 - protein, 21 aa, Artificial Sequence
  Description of Artificial Sequence: Synthetic peptide
  Seed: GSWSQKRSFVYVWKTWGQYWQ (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXYWQ

SEQ ID NO: 328294 - protein, 21 aa, Artificial Sequence
  Description of Artificial Sequence: Synthetic peptide
  Seed: GSWSQKRSFVYVWKTWGQYWQ (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQXWQ

SEQ ID NO: 328295 - protein, 22 aa, Artificial Sequence
  Description of Artificial Sequence: Synthetic peptide
  Seed: GSWSQKRSFVYVWKTWGQYWQV (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQYWQV

SEQ ID NO: 328296 - protein, 22 aa, Artificial Sequence
  Description of Artificial Sequence: Synthetic peptide
  Seed: GSWSQKRSFVYVWKTWGQYWQV (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQYWQV

SEQ ID NO: 328297 - protein, 22 aa, Artificial Sequence
  Description of Artificial Sequence: Synthetic peptide
  Seed: GSWSQKRSFVYVWKTWGQYWQV (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXYWQV

SEQ ID NO: 328298 - protein, 22 aa, Artificial Sequence
  Description of Artificial Sequence: Synthetic peptide
  Seed: GSWSQKRSFVYVWKTWGQYWQV (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQXWQV

SEQ ID NO: 328299 - protein, 23 aa, Artificial Sequence
  Description of Artificial Sequence: Synthetic peptide
  Seed: GSWSQKRSFVYVWKTWGQYWQVL (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQYWQVL

SEQ ID NO: 328300 - protein, 23 aa, Artificial Sequence
  Description of Artificial Sequence: Synthetic peptide
  Seed: GSWSQKRSFVYVWKTWGQYWQVL (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQYWQVL

SEQ ID NO: 328301 - protein, 23 aa, Artificial Sequence
  Description of Artificial Sequence: Synthetic peptide
  Seed: GSWSQKRSFVYVWKTWGQYWQVL (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXYWQVL

SEQ ID NO: 328302 - protein, 23 aa, Artificial Sequence
  Description of Artificial Sequence: Synthetic peptide
  Seed: GSWSQKRSFVYVWKTWGQYWQVL (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQXWQVL

SEQ ID NO: 328303 - protein, 24 aa, Artificial Sequence
  Description of Artificial Sequence: Synthetic peptide
  Seed: GSWSQKRSFVYVWKTWGQYWQVLG (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQYWQVLG

SEQ ID NO: 328304 - protein, 24 aa, Artificial Sequence
  Description of Artificial Sequence: Synthetic peptide
  Seed: GSWSQKRSFVYVWKTWGQYWQVLG (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQYWQVLG

SEQ ID NO: 328305 - protein, 24 aa, Artificial Sequence
  Description of Artificial Sequence: Synthetic peptide
  Seed: GSWSQKRSFVYVWKTWGQYWQVLG (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXYWQVLG

SEQ ID NO: 328306 - protein, 24 aa, Artificial Sequence
  Description of Artificial Sequence: Synthetic peptide
  Seed: GSWSQKRSFVYVWKTWGQYWQVLG (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQXWQVLG

SEQ ID NO: 328307 - protein, 25 aa, Artificial Sequence
  Description of Artificial Sequence: Synthetic peptide
  Seed: GSWSQKRSFVYVWKTWGQYWQVLGG (PMEL_HUMAN)
  Core: RSFVYVWKT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKXSFXYXWKXWGQYWQVLGG

SEQ ID NO: 328308 - protein, 25 aa, Artificial Sequence
  Description of Artificial Sequence: Synthetic peptide
  Seed: GSWSQKRSFVYVWKTWGQYWQVLGG (PMEL_HUMAN)
  Core: FVYVWKTWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSXVYXWXTWXQYWQVLGG

SEQ ID NO: 328309 - protein, 25 aa, Artificial Sequence
  Description of Artificial Sequence: Synthetic peptide
  Seed: GSWSQKRSFVYVWKTWGQYWQVLGG (PMEL_HUMAN)
  Core: VYVWKTWGQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFXYVXKXWGXYWQVLGG

SEQ ID NO: 328310 - protein, 25 aa, Artificial Sequence
  Description of Artificial Sequence: Synthetic peptide
  Seed: GSWSQKRSFVYVWKTWGQYWQVLGG (PMEL_HUMAN)
  Core: YVWKTWGQY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GSWSQKRSFVXVWXTXGQXWQVLGG

SEQ ID NO: 328311 - protein, 13 aa, Artificial Sequence
  Description of Artificial Sequence: Synthetic peptide
  Seed: GTATLRLVKRQVP (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVX

SEQ ID NO: 328312 - protein, 14 aa, Artificial Sequence
  Description of Artificial Sequence: Synthetic peptide
  Seed: GTATLRLVKRQVPL (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXL

SEQ ID NO: 328313 - protein, 15 aa, Artificial Sequence
  Description of Artificial Sequence: Synthetic peptide
  Seed: GTATLRLVKRQVPLD (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLD

SEQ ID NO: 328314 - protein, 16 aa, Artificial Sequence
  Description of Artificial Sequence: Synthetic peptide
  Seed: GTATLRLVKRQVPLDC (PMEL_HUMAN)
  Core: TLRLVKRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTAXLRXVXRQXPLDC

SEQ ID NO: 328315 - protein, 16 aa, Artificial Sequence
  Description of Artificial Sequence: Synthetic peptide
  Seed: GTATLRLVKRQVPLDC (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDC

SEQ ID NO: 328316 - protein, 17 aa, Artificial Sequence
  Description of Artificial Sequence: Synthetic peptide
  Seed: GTATLRLVKRQVPLDCV (PMEL_HUMAN)
  Core: TLRLVKRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTAXLRXVXRQXPLDCV

SEQ ID NO: 328317 - protein, 17 aa, Artificial Sequence
  Description of Artificial Sequence: Synthetic peptide
  Seed: GTATLRLVKRQVPLDCV (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCV

SEQ ID NO: 328318 - protein, 17 aa, Artificial Sequence
  Description of Artificial Sequence: Synthetic peptide
  Seed: GTATLRLVKRQVPLDCV (PMEL_HUMAN)
  Core: RLVKRQVPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTATLXLVXRXVPXDCV

SEQ ID NO: 328319 - protein, 17 aa, Artificial Sequence
  Description of Artificial Sequence: Synthetic peptide
  Seed: GTATLRLVKRQVPLDCV (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCV

SEQ ID NO: 328320 - protein, 17 aa, Artificial Sequence
  Description of Artificial Sequence: Synthetic peptide
  Seed: GTATLRLVKRQVPLDCV (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXV

SEQ ID NO: 328321 - protein, 18 aa, Artificial Sequence
  Description of Artificial Sequence: Synthetic peptide
  Seed: GTATLRLVKRQVPLDCVL (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVL

SEQ ID NO: 328322 - protein, 18 aa, Artificial Sequence
  Description of Artificial Sequence: Synthetic peptide
  Seed: GTATLRLVKRQVPLDCVL (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVL

SEQ ID NO: 328323 - protein, 19 aa, Artificial Sequence
  Description of Artificial Sequence: Synthetic peptide
  Seed: GTATLRLVKRQVPLDCVLY (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLY

SEQ ID NO: 328324 - protein, 19 aa, Artificial Sequence
  Description of Artificial Sequence: Synthetic peptide
  Seed: GTATLRLVKRQVPLDCVLY (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLY

SEQ ID NO: 328325 - protein, 19 aa, Artificial Sequence
  Description of Artificial Sequence: Synthetic peptide
  Seed: GTATLRLVKRQVPLDCVLY (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLY

SEQ ID NO: 328326 - protein, 19 aa, Artificial Sequence
  Description of Artificial Sequence: Synthetic peptide
  Seed: GTATLRLVKRQVPLDCVLY (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLY

SEQ ID NO: 328327 - protein, 20 aa, Artificial Sequence
  Description of Artificial Sequence: Synthetic peptide
  Seed: GTATLRLVKRQVPLDCVLYR (PMEL_HUMAN)
  Core: TLRLVKRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTAXLRXVXRQXPLDCVLYR

SEQ ID NO: 328328 - protein, 20 aa, Artificial Sequence
  Description of Artificial Sequence: Synthetic peptide
  Seed: GTATLRLVKRQVPLDCVLYR (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLYR

SEQ ID NO: 328329 - protein, 20 aa, Artificial Sequence
  Description of Artificial Sequence: Synthetic peptide
  Seed: GTATLRLVKRQVPLDCVLYR (PMEL_HUMAN)
  Core: RLVKRQVPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTATLXLVXRXVPXDCVLYR

SEQ ID NO: 328330 - protein, 20 aa, Artificial Sequence
  Description of Artificial Sequence: Synthetic peptide
  Seed: GTATLRLVKRQVPLDCVLYR (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLYR

SEQ ID NO: 328331 - protein, 20 aa, Artificial Sequence
  Description of Artificial Sequence: Synthetic peptide
  Seed: GTATLRLVKRQVPLDCVLYR (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLYR

SEQ ID NO: 328332 - protein, 20 aa, Artificial Sequence
  Description of Artificial Sequence: Synthetic peptide
  Seed: GTATLRLVKRQVPLDCVLYR (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLYR

SEQ ID NO: 328333 - protein, 21 aa, Artificial Sequence
  Description of Artificial Sequence: Synthetic peptide
  Seed: GTATLRLVKRQVPLDCVLYRY (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLYRY

SEQ ID NO: 328334 - protein, 21 aa, Artificial Sequence
  Description of Artificial Sequence: Synthetic peptide
  Seed: GTATLRLVKRQVPLDCVLYRY (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLYRY

SEQ ID NO: 328335 - protein, 21 aa, Artificial Sequence
  Description of Artificial Sequence: Synthetic peptide
  Seed: GTATLRLVKRQVPLDCVLYRY (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLYRY

SEQ ID NO: 328336 - protein, 21 aa, Artificial Sequence
  Description of Artificial Sequence: Synthetic peptide
  Seed: GTATLRLVKRQVPLDCVLYRY (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLYRY

SEQ ID NO: 328337 - protein, 21 aa, Artificial Sequence
  Description of Artificial Sequence: Synthetic peptide
  Seed: GTATLRLVKRQVPLDCVLYRY (PMEL_HUMAN)
  Core: QVPLDCVLY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRXVPXDXVLXRY

SEQ ID NO: 328338 - protein, 21 aa, Artificial Sequence
  Description of Artificial Sequence: Synthetic peptide
  Seed: GTATLRLVKRQVPLDCVLYRY (PMEL_HUMAN)
  Core: VPLDCVLYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQXPLXCXLYXY

SEQ ID NO: 328339 - protein, 22 aa, Artificial Sequence
  Description of Artificial Sequence: Synthetic peptide
  Seed: GTATLRLVKRQVPLDCVLYRYG (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLYRYG

SEQ ID NO: 328340 - protein, 22 aa, Artificial Sequence
  Description of Artificial Sequence: Synthetic peptide
  Seed: GTATLRLVKRQVPLDCVLYRYG (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLYRYG

SEQ ID NO: 328341 - protein, 22 aa, Artificial Sequence
  Description of Artificial Sequence: Synthetic peptide
  Seed: GTATLRLVKRQVPLDCVLYRYG (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLYRYG

SEQ ID NO: 328342 - protein, 22 aa, Artificial Sequence
  Description of Artificial Sequence: Synthetic peptide
  Seed: GTATLRLVKRQVPLDCVLYRYG (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLYRYG

SEQ ID NO: 328343 - protein, 22 aa, Artificial Sequence
  Description of Artificial Sequence: Synthetic peptide
  Seed: GTATLRLVKRQVPLDCVLYRYG (PMEL_HUMAN)
  Core: QVPLDCVLY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRXVPXDXVLXRYG

SEQ ID NO: 328344 - protein, 22 aa, Artificial Sequence
  Description of Artificial Sequence: Synthetic peptide
  Seed: GTATLRLVKRQVPLDCVLYRYG (PMEL_HUMAN)
  Core: VPLDCVLYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQXPLXCXLYXYG

SEQ ID NO: 328345 - protein, 23 aa, Artificial Sequence
  Description of Artificial Sequence: Synthetic peptide
  Seed: GTATLRLVKRQVPLDCVLYRYGS (PMEL_HUMAN)
  Core: TLRLVKRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTAXLRXVXRQXPLDCVLYRYGS

SEQ ID NO: 328346 - protein, 23 aa, Artificial Sequence
  Description of Artificial Sequence: Synthetic peptide
  Seed: GTATLRLVKRQVPLDCVLYRYGS (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLYRYGS

SEQ ID NO: 328347 - protein, 23 aa, Artificial Sequence
  Description of Artificial Sequence: Synthetic peptide
  Seed: GTATLRLVKRQVPLDCVLYRYGS (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLYRYGS

SEQ ID NO: 328348 - protein, 23 aa, Artificial Sequence
  Description of Artificial Sequence: Synthetic peptide
  Seed: GTATLRLVKRQVPLDCVLYRYGS (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLYRYGS

SEQ ID NO: 328349 - protein, 23 aa, Artificial Sequence
  Description of Artificial Sequence: Synthetic peptide
  Seed: GTATLRLVKRQVPLDCVLYRYGS (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLYRYGS

SEQ ID NO: 328350 - protein, 23 aa, Artificial Sequence
  Description of Artificial Sequence: Synthetic peptide
  Seed: GTATLRLVKRQVPLDCVLYRYGS (PMEL_HUMAN)
  Core: QVPLDCVLY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRXVPXDXVLXRYGS

SEQ ID NO: 328351 - protein, 23 aa, Artificial Sequence
  Description of Artificial Sequence: Synthetic peptide
  Seed: GTATLRLVKRQVPLDCVLYRYGS (PMEL_HUMAN)
  Core: VPLDCVLYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQXPLXCXLYXYGS

SEQ ID NO: 328352 - protein, 23 aa, Artificial Sequence
  Description of Artificial Sequence: Synthetic peptide
  Seed: GTATLRLVKRQVPLDCVLYRYGS (PMEL_HUMAN)
  Core: LDCVLYRYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQVPXDCXLXRYXS

SEQ ID NO: 328353 - protein, 24 aa, Artificial Sequence
  Description of Artificial Sequence: Synthetic peptide
  Seed: GTATLRLVKRQVPLDCVLYRYGSF (PMEL_HUMAN)
  Core: TLRLVKRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTAXLRXVXRQXPLDCVLYRYGSF

SEQ ID NO: 328354 - protein, 24 aa, Artificial Sequence
  Description of Artificial Sequence: Synthetic peptide
  Seed: GTATLRLVKRQVPLDCVLYRYGSF (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLYRYGSF

SEQ ID NO: 328355 - protein, 24 aa, Artificial Sequence
  Description of Artificial Sequence: Synthetic peptide
  Seed: GTATLRLVKRQVPLDCVLYRYGSF (PMEL_HUMAN)
  Core: RLVKRQVPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTATLXLVXRXVPXDCVLYRYGSF

SEQ ID NO: 328356 - protein, 24 aa, Artificial Sequence
  Description of Artificial Sequence: Synthetic peptide
  Seed: GTATLRLVKRQVPLDCVLYRYGSF (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLYRYGSF

SEQ ID NO: 328357 - protein, 24 aa, Artificial Sequence
  Description of Artificial Sequence: Synthetic peptide
  Seed: GTATLRLVKRQVPLDCVLYRYGSF (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLYRYGSF

SEQ ID NO: 328358 - protein, 24 aa, Artificial Sequence
  Description of Artificial Sequence: Synthetic peptide
  Seed: GTATLRLVKRQVPLDCVLYRYGSF (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLYRYGSF

SEQ ID NO: 328359 - protein, 24 aa, Artificial Sequence
  Description of Artificial Sequence: Synthetic peptide
  Seed: GTATLRLVKRQVPLDCVLYRYGSF (PMEL_HUMAN)
  Core: QVPLDCVLY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRXVPXDXVLXRYGSF

SEQ ID NO: 328360 - protein, 24 aa, Artificial Sequence
  Description of Artificial Sequence: Synthetic peptide
  Seed: GTATLRLVKRQVPLDCVLYRYGSF (PMEL_HUMAN)
  Core: VPLDCVLYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQXPLXCXLYXYGSF

SEQ ID NO: 328361 - protein, 24 aa, Artificial Sequence
  Description of Artificial Sequence: Synthetic peptide
  Seed: GTATLRLVKRQVPLDCVLYRYGSF (PMEL_HUMAN)
  Core: LDCVLYRYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQVPXDCXLXRYXSF

SEQ ID NO: 328362 - protein, 25 aa, Artificial Sequence
  Description of Artificial Sequence: Synthetic peptide
  Seed: GTATLRLVKRQVPLDCVLYRYGSFS (PMEL_HUMAN)
  Core: TLRLVKRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTAXLRXVXRQXPLDCVLYRYGSFS

SEQ ID NO: 328363 - protein, 25 aa, Artificial Sequence
  Description of Artificial Sequence: Synthetic peptide
  Seed: GTATLRLVKRQVPLDCVLYRYGSFS (PMEL_HUMAN)
  Core: LRLVKRQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTATXRLXKXQVXLDCVLYRYGSFS

SEQ ID NO: 328364 - protein, 25 aa, Artificial Sequence
  Description of Artificial Sequence: Synthetic peptide
  Seed: GTATLRLVKRQVPLDCVLYRYGSFS (PMEL_HUMAN)
  Core: RLVKRQVPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTATLXLVXRXVPXDCVLYRYGSFS

SEQ ID NO: 328365 - protein, 25 aa, Artificial Sequence
  Description of Artificial Sequence: Synthetic peptide
  Seed: GTATLRLVKRQVPLDCVLYRYGSFS (PMEL_HUMAN)
  Core: LVKRQVPLD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRXVKXQXPLXCVLYRYGSFS

SEQ ID NO: 328366 - protein, 25 aa, Artificial Sequence
  Description of Artificial Sequence: Synthetic peptide
  Seed: GTATLRLVKRQVPLDCVLYRYGSFS (PMEL_HUMAN)
  Core: VKRQVPLDC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLXKRXVXLDXVLYRYGSFS

SEQ ID NO: 328367 - protein, 25 aa, Artificial Sequence
  Description of Artificial Sequence: Synthetic peptide
  Seed: GTATLRLVKRQVPLDCVLYRYGSFS (PMEL_HUMAN)
  Core: KRQVPLDCV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVXRQXPXDCXLYRYGSFS

SEQ ID NO: 328368 - protein, 25 aa, Artificial Sequence
  Description of Artificial Sequence: Synthetic peptide
  Seed: GTATLRLVKRQVPLDCVLYRYGSFS (PMEL_HUMAN)
  Core: QVPLDCVLY
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRXVPXDXVLXRYGSFS

SEQ ID NO: 328369 - protein, 25 aa, Artificial Sequence
  Description of Artificial Sequence: Synthetic peptide
  Seed: GTATLRLVKRQVPLDCVLYRYGSFS (PMEL_HUMAN)
  Core: VPLDCVLYR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQXPLXCXLYXYGSFS

SEQ ID NO: 328370 - protein, 25 aa, Artificial Sequence
  Description of Artificial Sequence: Synthetic peptide
  Seed: GTATLRLVKRQVPLDCVLYRYGSFS (PMEL_HUMAN)
  Core: LDCVLYRYG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTATLRLVKRQVPXDCXLXRYXSFS

SEQ ID NO: 328371 - protein, 14 aa, Artificial Sequence
  Description of Artificial Sequence: Synthetic peptide
  Seed: GTGRAMLGTHTMEV (PMEL_HUMAN)
  Core: GRAMLGTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXRAXLXTHXMEV

SEQ ID NO: 328372 - protein, 14 aa, Artificial Sequence
  Description of Artificial Sequence: Synthetic peptide
  Seed: GTGRAMLGTHTMEV (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEX

SEQ ID NO: 328373 - protein, 15 aa, Artificial Sequence
  Description of Artificial Sequence: Synthetic peptide
  Seed: GTGRAMLGTHTMEVT (PMEL_HUMAN)
  Core: GRAMLGTHT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXRAXLXTHXMEVT

SEQ ID NO: 328374 - protein, 15 aa, Artificial Sequence
  Description of Artificial Sequence: Synthetic peptide
  Seed: GTGRAMLGTHTMEVT (PMEL_HUMAN)
  Core: RAMLGTHTM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTGXAMXGXHTXEVT

SEQ ID NO: 328375 - protein, 15 aa, Artificial Sequence
  Description of Artificial Sequence: Synthetic peptide
  Seed: GTGRAMLGTHTMEVT (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXT

SEQ ID NO: 328376 - protein, 16 aa, Artificial Sequence
  Description of Artificial Sequence: Synthetic peptide
  Seed: GTGRAMLGTHTMEVTV (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTV

SEQ ID NO: 328377 - protein, 17 aa, Artificial Sequence
  Description of Artificial Sequence: Synthetic peptide
  Seed: GTGRAMLGTHTMEVTVY (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVY

SEQ ID NO: 328378 - protein, 18 aa, Artificial Sequence
  Description of Artificial Sequence: Synthetic peptide
  Seed: GTGRAMLGTHTMEVTVYH (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYH

SEQ ID NO: 328379 - protein, 18 aa, Artificial Sequence
  Description of Artificial Sequence: Synthetic peptide
  Seed: GTGRAMLGTHTMEVTVYH (PMEL_HUMAN)
  Core: LGTHTMEVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMXGTXTXEVXVYH

SEQ ID NO: 328380 - protein, 19 aa, Artificial Sequence
  Description of Artificial Sequence: Synthetic peptide
  Seed: GTGRAMLGTHTMEVTVYHR (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHR

SEQ ID NO: 328381 - protein, 19 aa, Artificial Sequence
  Description of Artificial Sequence: Synthetic peptide
  Seed: GTGRAMLGTHTMEVTVYHR (PMEL_HUMAN)
  Core: LGTHTMEVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMXGTXTXEVXVYHR

SEQ ID NO: 328382 - protein, 19 aa, Artificial Sequence
  Description of Artificial Sequence: Synthetic peptide
  Seed: GTGRAMLGTHTMEVTVYHR (PMEL_HUMAN)
  Core: THTMEVTVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGXHTXEXTVXHR

SEQ ID NO: 328383 - protein, 20 aa, Artificial Sequence
  Description of Artificial Sequence: Synthetic peptide
  Seed: GTGRAMLGTHTMEVTVYHRR (PMEL_HUMAN)
  Core: RAMLGTHTM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTGXAMXGXHTXEVTVYHRR

SEQ ID NO: 328384 - protein, 20 aa, Artificial Sequence
  Description of Artificial Sequence: Synthetic peptide
  Seed: GTGRAMLGTHTMEVTVYHRR (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHRR

SEQ ID NO: 328385 - protein, 20 aa, Artificial Sequence
  Description of Artificial Sequence: Synthetic peptide
  Seed: GTGRAMLGTHTMEVTVYHRR (PMEL_HUMAN)
  Core: LGTHTMEVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMXGTXTXEVXVYHRR

SEQ ID NO: 328386 - protein, 20 aa, Artificial Sequence
  Description of Artificial Sequence: Synthetic peptide
  Seed: GTGRAMLGTHTMEVTVYHRR (PMEL_HUMAN)
  Core: THTMEVTVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGXHTXEXTVXHRR

SEQ ID NO: 328387 - protein, 20 aa, Artificial Sequence
  Description of Artificial Sequence: Synthetic peptide
  Seed: GTGRAMLGTHTMEVTVYHRR (PMEL_HUMAN)
  Core: MEVTVYHRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTXEVXVXHRX

SEQ ID NO: 328388 - protein, 21 aa, Artificial Sequence
  Description of Artificial Sequence: Synthetic peptide
  Seed: GTGRAMLGTHTMEVTVYHRRG (PMEL_HUMAN)
  Core: RAMLGTHTM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTGXAMXGXHTXEVTVYHRRG

SEQ ID NO: 328389 - protein, 21 aa, Artificial Sequence
  Description of Artificial Sequence: Synthetic peptide
  Seed: GTGRAMLGTHTMEVTVYHRRG (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHRRG

SEQ ID NO: 328390 - protein, 21 aa, Artificial Sequence
  Description of Artificial Sequence: Synthetic peptide
  Seed: GTGRAMLGTHTMEVTVYHRRG (PMEL_HUMAN)
  Core: LGTHTMEVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMXGTXTXEVXVYHRRG

SEQ ID NO: 328391 - protein, 21 aa, Artificial Sequence
  Description of Artificial Sequence: Synthetic peptide
  Seed: GTGRAMLGTHTMEVTVYHRRG (PMEL_HUMAN)
  Core: MEVTVYHRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTXEVXVXHRXG

SEQ ID NO: 328392 - protein, 22 aa, Artificial Sequence
  Description of Artificial Sequence: Synthetic peptide
  Seed: GTGRAMLGTHTMEVTVYHRRGS (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHRRGS

SEQ ID NO: 328393 - protein, 22 aa, Artificial Sequence
  Description of Artificial Sequence: Synthetic peptide
  Seed: GTGRAMLGTHTMEVTVYHRRGS (PMEL_HUMAN)
  Core: LGTHTMEVT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMXGTXTXEVXVYHRRGS

SEQ ID NO: 328394 - protein, 22 aa, Artificial Sequence
  Description of Artificial Sequence: Synthetic peptide
  Seed: GTGRAMLGTHTMEVTVYHRRGS (PMEL_HUMAN)
  Core: HTMEVTVYH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTXTMXVXVYXRRGS

SEQ ID NO: 328395 - protein, 22 aa, Artificial Sequence
  Description of Artificial Sequence: Synthetic peptide
  Seed: GTGRAMLGTHTMEVTVYHRRGS (PMEL_HUMAN)
  Core: MEVTVYHRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTXEVXVXHRXGS

SEQ ID NO: 328396 - protein, 22 aa, Artificial Sequence
  Description of Artificial Sequence: Synthetic peptide
  Seed: GTGRAMLGTHTMEVTVYHRRGS (PMEL_HUMAN)
  Core: VTVYHRRGS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTMEXTVXHXRGX

SEQ ID NO: 328397 - protein, 23 aa, Artificial Sequence
  Description of Artificial Sequence: Synthetic peptide
  Seed: GTGRAMLGTHTMEVTVYHRRGSR (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHRRGSR

SEQ ID NO: 328398 - protein, 23 aa, Artificial Sequence
  Description of Artificial Sequence: Synthetic peptide
  Seed: GTGRAMLGTHTMEVTVYHRRGSR (PMEL_HUMAN)
  Core: HTMEVTVYH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTXTMXVXVYXRRGSR

SEQ ID NO: 328399 - protein, 23 aa, Artificial Sequence
  Description of Artificial Sequence: Synthetic peptide
  Seed: GTGRAMLGTHTMEVTVYHRRGSR (PMEL_HUMAN)
  Core: MEVTVYHRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTXEVXVXHRXGSR

SEQ ID NO: 328400 - protein, 23 aa, Artificial Sequence
  Description of Artificial Sequence: Synthetic peptide
  Seed: GTGRAMLGTHTMEVTVYHRRGSR (PMEL_HUMAN)
  Core: VTVYHRRGS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTMEXTVXHXRGXR

SEQ ID NO: 328401 - protein, 24 aa, Artificial Sequence
  Description of Artificial Sequence: Synthetic peptide
  Seed: GTGRAMLGTHTMEVTVYHRRGSRS (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHRRGSRS

SEQ ID NO: 328402 - protein, 24 aa, Artificial Sequence
  Description of Artificial Sequence: Synthetic peptide
  Seed: GTGRAMLGTHTMEVTVYHRRGSRS (PMEL_HUMAN)
  Core: THTMEVTVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGXHTXEXTVXHRRGSRS

SEQ ID NO: 328403 - protein, 24 aa, Artificial Sequence
  Description of Artificial Sequence: Synthetic peptide
  Seed: GTGRAMLGTHTMEVTVYHRRGSRS (PMEL_HUMAN)
  Core: HTMEVTVYH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTXTMXVXVYXRRGSRS

SEQ ID NO: 328404 - protein, 24 aa, Artificial Sequence
  Description of Artificial Sequence: Synthetic peptide
  Seed: GTGRAMLGTHTMEVTVYHRRGSRS (PMEL_HUMAN)
  Core: MEVTVYHRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTXEVXVXHRXGSRS

SEQ ID NO: 328405 - protein, 24 aa, Artificial Sequence
  Description of Artificial Sequence: Synthetic peptide
  Seed: GTGRAMLGTHTMEVTVYHRRGSRS (PMEL_HUMAN)
  Core: VTVYHRRGS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTMEXTVXHXRGXRS

SEQ ID NO: 328406 - protein, 25 aa, Artificial Sequence
  Description of Artificial Sequence: Synthetic peptide
  Seed: GTGRAMLGTHTMEVTVYHRRGSRSY (PMEL_HUMAN)
  Core: MLGTHTMEV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAXLGXHXMEXTVYHRRGSRSY

SEQ ID NO: 328407 - protein, 25 aa, Artificial Sequence
  Description of Artificial Sequence: Synthetic peptide
  Seed: GTGRAMLGTHTMEVTVYHRRGSRSY (PMEL_HUMAN)
  Core: THTMEVTVY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGXHTXEXTVXHRRGSRSY

SEQ ID NO: 328408 - protein, 25 aa, Artificial Sequence
  Description of Artificial Sequence: Synthetic peptide
  Seed: GTGRAMLGTHTMEVTVYHRRGSRSY (PMEL_HUMAN)
  Core: HTMEVTVYH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTXTMXVXVYXRRGSRSY

SEQ ID NO: 328409 - protein, 25 aa, Artificial Sequence
  Description of Artificial Sequence: Synthetic peptide
  Seed: GTGRAMLGTHTMEVTVYHRRGSRSY (PMEL_HUMAN)
  Core: MEVTVYHRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTXEVXVXHRXGSRSY

SEQ ID NO: 328410 - protein, 25 aa, Artificial Sequence
  Description of Artificial Sequence: Synthetic peptide
  Seed: GTGRAMLGTHTMEVTVYHRRGSRSY (PMEL_HUMAN)
  Core: VTVYHRRGS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTGRAMLGTHTMEXTVXHXRGXRSY

SEQ ID NO: 328411 - protein, 15 aa, Artificial Sequence
  Description of Artificial Sequence: Synthetic peptide
  Seed: GTHTMEVTVYHRRGS (PMEL_HUMAN)
  Core: MEVTVYHRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTHTXEVXVXHRXGS

SEQ ID NO: 328412 - protein, 15 aa, Artificial Sequence
  Description of Artificial Sequence: Synthetic peptide
  Seed: GTHTMEVTVYHRRGS (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGX

SEQ ID NO: 328413 - protein, 16 aa, Artificial Sequence
  Description of Artificial Sequence: Synthetic peptide
  Seed: GTHTMEVTVYHRRGSR (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXR

SEQ ID NO: 328414 - protein, 17 aa, Artificial Sequence
  Description of Artificial Sequence: Synthetic peptide
  Seed: GTHTMEVTVYHRRGSRS (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRS

SEQ ID NO: 328415 - protein, 18 aa, Artificial Sequence
  Description of Artificial Sequence: Synthetic peptide
  Seed: GTHTMEVTVYHRRGSRSY (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSY

SEQ ID NO: 328416 - protein, 19 aa, Artificial Sequence
  Description of Artificial Sequence: Synthetic peptide
  Seed: GTHTMEVTVYHRRGSRSYV (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYV

SEQ ID NO: 328417 - protein, 20 aa, Artificial Sequence
  Description of Artificial Sequence: Synthetic peptide
  Seed: GTHTMEVTVYHRRGSRSYVP (PMEL_HUMAN)
  Core: MEVTVYHRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTHTXEVXVXHRXGSRSYVP

SEQ ID NO: 328418 - protein, 20 aa, Artificial Sequence
  Description of Artificial Sequence: Synthetic peptide
  Seed: GTHTMEVTVYHRRGSRSYVP (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYVP

SEQ ID NO: 328419 - protein, 20 aa, Artificial Sequence
  Description of Artificial Sequence: Synthetic peptide
  Seed: GTHTMEVTVYHRRGSRSYVP (PMEL_HUMAN)
  Core: YHRRGSRSY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVXHRXGXRSXVP

SEQ ID NO: 328420 - protein, 21 aa, Artificial Sequence
  Description of Artificial Sequence: Synthetic peptide
  Seed: GTHTMEVTVYHRRGSRSYVPL (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYVPL

SEQ ID NO: 328421 - protein, 22 aa, Artificial Sequence
  Description of Artificial Sequence: Synthetic peptide
  Seed: GTHTMEVTVYHRRGSRSYVPLA (PMEL_HUMAN)
  Core: MEVTVYHRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTHTXEVXVXHRXGSRSYVPLA

SEQ ID NO: 328422 - protein, 22 aa, Artificial Sequence
  Description of Artificial Sequence: Synthetic peptide
  Seed: GTHTMEVTVYHRRGSRSYVPLA (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYVPLA

SEQ ID NO: 328423 - protein, 23 aa, Artificial Sequence
  Description of Artificial Sequence: Synthetic peptide
  Seed: GTHTMEVTVYHRRGSRSYVPLAH (PMEL_HUMAN)
  Core: MEVTVYHRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTHTXEVXVXHRXGSRSYVPLAH

SEQ ID NO: 328424 - protein, 23 aa, Artificial Sequence
  Description of Artificial Sequence: Synthetic peptide
  Seed: GTHTMEVTVYHRRGSRSYVPLAH (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYVPLAH

SEQ ID NO: 328425 - protein, 23 aa, Artificial Sequence
  Description of Artificial Sequence: Synthetic peptide
  Seed: GTHTMEVTVYHRRGSRSYVPLAH (PMEL_HUMAN)
  Core: YHRRGSRSY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVXHRXGXRSXVPLAH

SEQ ID NO: 328426 - protein, 23 aa, Artificial Sequence
  Description of Artificial Sequence: Synthetic peptide
  Seed: GTHTMEVTVYHRRGSRSYVPLAH (PMEL_HUMAN)
  Core: RRGSRSYVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHXRGXRXYVXLAH

SEQ ID NO: 328427 - protein, 24 aa, Artificial Sequence
  Description of Artificial Sequence: Synthetic peptide
  Seed: GTHTMEVTVYHRRGSRSYVPLAHS (PMEL_HUMAN)
  Core: MEVTVYHRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTHTXEVXVXHRXGSRSYVPLAHS

SEQ ID NO: 328428 - protein, 24 aa, Artificial Sequence
  Description of Artificial Sequence: Synthetic peptide
  Seed: GTHTMEVTVYHRRGSRSYVPLAHS (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYVPLAHS

SEQ ID NO: 328429 - protein, 24 aa, Artificial Sequence
  Description of Artificial Sequence: Synthetic peptide
  Seed: GTHTMEVTVYHRRGSRSYVPLAHS (PMEL_HUMAN)
  Core: YHRRGSRSY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVXHRXGXRSXVPLAHS

SEQ ID NO: 328430 - protein, 24 aa, Artificial Sequence
  Description of Artificial Sequence: Synthetic peptide
  Seed: GTHTMEVTVYHRRGSRSYVPLAHS (PMEL_HUMAN)
  Core: GSRSYVPLA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHRRXSRXYXPLXHS

SEQ ID NO: 328431 - protein, 24 aa, Artificial Sequence
  Description of Artificial Sequence: Synthetic peptide
  Seed: GTHTMEVTVYHRRGSRSYVPLAHS (PMEL_HUMAN)
  Core: SRSYVPLAH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHRRGXRSXVXLAXS

SEQ ID NO: 328432 - protein, 24 aa, Artificial Sequence
  Description of Artificial Sequence: Synthetic peptide
  Seed: GTHTMEVTVYHRRGSRSYVPLAHS (PMEL_HUMAN)
  Core: RSYVPLAHS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHRRGSXSYXPXAHX

SEQ ID NO: 328433 - protein, 25 aa, Artificial Sequence
  Description of Artificial Sequence: Synthetic peptide
  Seed: GTHTMEVTVYHRRGSRSYVPLAHSS (PMEL_HUMAN)
  Core: MEVTVYHRR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTHTXEVXVXHRXGSRSYVPLAHSS

SEQ ID NO: 328434 - protein, 25 aa, Artificial Sequence
  Description of Artificial Sequence: Synthetic peptide
  Seed: GTHTMEVTVYHRRGSRSYVPLAHSS (PMEL_HUMAN)
  Core: VTVYHRRGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEXTVXHXRGXRSYVPLAHSS

SEQ ID NO: 328435 - protein, 25 aa, Artificial Sequence
  Description of Artificial Sequence: Synthetic peptide
  Seed: GTHTMEVTVYHRRGSRSYVPLAHSS (PMEL_HUMAN)
  Core: YHRRGSRSY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVXHRXGXRSXVPLAHSS

SEQ ID NO: 328436 - protein, 25 aa, Artificial Sequence
  Description of Artificial Sequence: Synthetic peptide
  Seed: GTHTMEVTVYHRRGSRSYVPLAHSS (PMEL_HUMAN)
  Core: GSRSYVPLA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHRRXSRXYXPLXHSS

SEQ ID NO: 328437 - protein, 25 aa, Artificial Sequence
  Description of Artificial Sequence: Synthetic peptide
  Seed: GTHTMEVTVYHRRGSRSYVPLAHSS (PMEL_HUMAN)
  Core: SRSYVPLAH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHRRGXRSXVXLAXSS

SEQ ID NO: 328438 - protein, 25 aa, Artificial Sequence
  Description of Artificial Sequence: Synthetic peptide
  Seed: GTHTMEVTVYHRRGSRSYVPLAHSS (PMEL_HUMAN)
  Core: RSYVPLAHS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
GTHTMEVTVYHRRGSXSYXPXAHXS

SEQ ID NO: 328439 - protein, 13 aa, Artificial Sequence
  Description of Artificial Sequence: Synthetic peptide
  Seed: GTLISRALVVTHT (PMEL_HUMAN)
  Core: ISRALVVTH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTLXSRXLXVTXT

SEQ ID NO: 328440 - protein, 14 aa, Artificial Sequence
  Description of Artificial Sequence: Synthetic peptide
  Seed: GTLISRALVVTHTY (PMEL_HUMAN)
  Core: TLISRALVV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXLIXRXLVXTHTY

SEQ ID NO: 328441 - protein, 14 aa, Artificial Sequence
  Description of Artificial Sequence: Synthetic peptide
  Seed: GTLISRALVVTHTY (PMEL_HUMAN)
  Core: LISRALVVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXISXAXVVXHTY

SEQ ID NO: 328442 - protein, 14 aa, Artificial Sequence
  Description of Artificial Sequence: Synthetic peptide
  Seed: GTLISRALVVTHTY (PMEL_HUMAN)
  Core: ISRALVVTH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTLXSRXLXVTXTY

SEQ ID NO: 328443 - protein, 14 aa, Artificial Sequence
  Description of Artificial Sequence: Synthetic peptide
  Seed: GTLISRALVVTHTY (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXY

SEQ ID NO: 328444 - protein, 15 aa, Artificial Sequence
  Description of Artificial Sequence: Synthetic peptide
  Seed: GTLISRALVVTHTYL (PMEL_HUMAN)
  Core: TLISRALVV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXLIXRXLVXTHTYL

SEQ ID NO: 328445 - protein, 15 aa, Artificial Sequence
  Description of Artificial Sequence: Synthetic peptide
  Seed: GTLISRALVVTHTYL (PMEL_HUMAN)
  Core: LISRALVVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXISXAXVVXHTYL

SEQ ID NO: 328446 - protein, 15 aa, Artificial Sequence
  Description of Artificial Sequence: Synthetic peptide
  Seed: GTLISRALVVTHTYL (PMEL_HUMAN)
  Core: ISRALVVTH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTLXSRXLXVTXTYL

SEQ ID NO: 328447 - protein, 15 aa, Artificial Sequence
  Description of Artificial Sequence: Synthetic peptide
  Seed: GTLISRALVVTHTYL (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYL

SEQ ID NO: 328448 - protein, 15 aa, Artificial Sequence
  Description of Artificial Sequence: Synthetic peptide
  Seed: GTLISRALVVTHTYL (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXL

SEQ ID NO: 328449 - protein, 16 aa, Artificial Sequence
  Description of Artificial Sequence: Synthetic peptide
  Seed: GTLISRALVVTHTYLE (PMEL_HUMAN)
  Core: LISRALVVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXISXAXVVXHTYLE

SEQ ID NO: 328450 - protein, 16 aa, Artificial Sequence
  Description of Artificial Sequence: Synthetic peptide
  Seed: GTLISRALVVTHTYLE (PMEL_HUMAN)
  Core: ISRALVVTH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTLXSRXLXVTXTYLE

SEQ ID NO: 328451 - protein, 16 aa, Artificial Sequence
  Description of Artificial Sequence: Synthetic peptide
  Seed: GTLISRALVVTHTYLE (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLE

SEQ ID NO: 328452 - protein, 16 aa, Artificial Sequence
  Description of Artificial Sequence: Synthetic peptide
  Seed: GTLISRALVVTHTYLE (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLE

SEQ ID NO: 328453 - protein, 16 aa, Artificial Sequence
  Description of Artificial Sequence: Synthetic peptide
  Seed: GTLISRALVVTHTYLE (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLX

SEQ ID NO: 328454 - protein, 17 aa, Artificial Sequence
  Description of Artificial Sequence: Synthetic peptide
  Seed: GTLISRALVVTHTYLEP (PMEL_HUMAN)
  Core: LISRALVVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXISXAXVVXHTYLEP

SEQ ID NO: 328455 - protein, 17 aa, Artificial Sequence
  Description of Artificial Sequence: Synthetic peptide
  Seed: GTLISRALVVTHTYLEP (PMEL_HUMAN)
  Core: ISRALVVTH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTLXSRXLXVTXTYLEP

SEQ ID NO: 328456 - protein, 17 aa, Artificial Sequence
  Description of Artificial Sequence: Synthetic peptide
  Seed: GTLISRALVVTHTYLEP (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEP

SEQ ID NO: 328457 - protein, 17 aa, Artificial Sequence
  Description of Artificial Sequence: Synthetic peptide
  Seed: GTLISRALVVTHTYLEP (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEP

SEQ ID NO: 328458 - protein, 17 aa, Artificial Sequence
  Description of Artificial Sequence: Synthetic peptide
  Seed: GTLISRALVVTHTYLEP (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXP

SEQ ID NO: 328459 - protein, 17 aa, Artificial Sequence
  Description of Artificial Sequence: Synthetic peptide
  Seed: GTLISRALVVTHTYLEP (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEX

SEQ ID NO: 328460 - protein, 18 aa, Artificial Sequence
  Description of Artificial Sequence: Synthetic peptide
  Seed: GTLISRALVVTHTYLEPG (PMEL_HUMAN)
  Core: ISRALVVTH
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTLXSRXLXVTXTYLEPG

SEQ ID NO: 328461 - protein, 18 aa, Artificial Sequence
  Description of Artificial Sequence: Synthetic peptide
  Seed: GTLISRALVVTHTYLEPG (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPG

SEQ ID NO: 328462 - protein, 18 aa, Artificial Sequence
  Description of Artificial Sequence: Synthetic peptide
  Seed: GTLISRALVVTHTYLEPG (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXG

SEQ ID NO: 328463 - protein, 18 aa, Artificial Sequence
  Description of Artificial Sequence: Synthetic peptide
  Seed: GTLISRALVVTHTYLEPG (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPX

SEQ ID NO: 328464 - protein, 19 aa, Artificial Sequence
  Description of Artificial Sequence: Synthetic peptide
  Seed: GTLISRALVVTHTYLEPGP (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGP

SEQ ID NO: 328465 - protein, 19 aa, Artificial Sequence
  Description of Artificial Sequence: Synthetic peptide
  Seed: GTLISRALVVTHTYLEPGP (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGP

SEQ ID NO: 328466 - protein, 19 aa, Artificial Sequence
  Description of Artificial Sequence: Synthetic peptide
  Seed: GTLISRALVVTHTYLEPGP (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGP

SEQ ID NO: 328467 - protein, 19 aa, Artificial Sequence
  Description of Artificial Sequence: Synthetic peptide
  Seed: GTLISRALVVTHTYLEPGP (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGP

SEQ ID NO: 328468 - protein, 19 aa, Artificial Sequence
  Description of Artificial Sequence: Synthetic peptide
  Seed: GTLISRALVVTHTYLEPGP (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXP

SEQ ID NO: 328469 - protein, 20 aa, Artificial Sequence
  Description of Artificial Sequence: Synthetic peptide
  Seed: GTLISRALVVTHTYLEPGPV (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGPV

SEQ ID NO: 328470 - protein, 20 aa, Artificial Sequence
  Description of Artificial Sequence: Synthetic peptide
  Seed: GTLISRALVVTHTYLEPGPV (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGPV

SEQ ID NO: 328471 - protein, 20 aa, Artificial Sequence
  Description of Artificial Sequence: Synthetic peptide
  Seed: GTLISRALVVTHTYLEPGPV (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGPV

SEQ ID NO: 328472 - protein, 20 aa, Artificial Sequence
  Description of Artificial Sequence: Synthetic peptide
  Seed: GTLISRALVVTHTYLEPGPV (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGPV

SEQ ID NO: 328473 - protein, 20 aa, Artificial Sequence
  Description of Artificial Sequence: Synthetic peptide
  Seed: GTLISRALVVTHTYLEPGPV (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXPV

SEQ ID NO: 328474 - protein, 21 aa, Artificial Sequence
  Description of Artificial Sequence: Synthetic peptide
  Seed: GTLISRALVVTHTYLEPGPVT (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGPVT

SEQ ID NO: 328475 - protein, 21 aa, Artificial Sequence
  Description of Artificial Sequence: Synthetic peptide
  Seed: GTLISRALVVTHTYLEPGPVT (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGPVT

SEQ ID NO: 328476 - protein, 21 aa, Artificial Sequence
  Description of Artificial Sequence: Synthetic peptide
  Seed: GTLISRALVVTHTYLEPGPVT (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGPVT

SEQ ID NO: 328477 - protein, 21 aa, Artificial Sequence
  Description of Artificial Sequence: Synthetic peptide
  Seed: GTLISRALVVTHTYLEPGPVT (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGPVT

SEQ ID NO: 328478 - protein, 21 aa, Artificial Sequence
  Description of Artificial Sequence: Synthetic peptide
  Seed: GTLISRALVVTHTYLEPGPVT (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXPVT

SEQ ID NO: 328479 - protein, 22 aa, Artificial Sequence
  Description of Artificial Sequence: Synthetic peptide
  Seed: GTLISRALVVTHTYLEPGPVTA (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGPVTA

SEQ ID NO: 328480 - protein, 22 aa, Artificial Sequence
  Description of Artificial Sequence: Synthetic peptide
  Seed: GTLISRALVVTHTYLEPGPVTA (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGPVTA

SEQ ID NO: 328481 - protein, 22 aa, Artificial Sequence
  Description of Artificial Sequence: Synthetic peptide
  Seed: GTLISRALVVTHTYLEPGPVTA (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGPVTA

SEQ ID NO: 328482 - protein, 22 aa, Artificial Sequence
  Description of Artificial Sequence: Synthetic peptide
  Seed: GTLISRALVVTHTYLEPGPVTA (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGPVTA

SEQ ID NO: 328483 - protein, 22 aa, Artificial Sequence
  Description of Artificial Sequence: Synthetic peptide
  Seed: GTLISRALVVTHTYLEPGPVTA (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXPVTA

SEQ ID NO: 328484 - protein, 23 aa, Artificial Sequence
  Description of Artificial Sequence: Synthetic peptide
  Seed: GTLISRALVVTHTYLEPGPVTAQ (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGPVTAQ

SEQ ID NO: 328485 - protein, 23 aa, Artificial Sequence
  Description of Artificial Sequence: Synthetic peptide
  Seed: GTLISRALVVTHTYLEPGPVTAQ (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGPVTAQ

SEQ ID NO: 328486 - protein, 23 aa, Artificial Sequence
  Description of Artificial Sequence: Synthetic peptide
  Seed: GTLISRALVVTHTYLEPGPVTAQ (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGPVTAQ

SEQ ID NO: 328487 - protein, 23 aa, Artificial Sequence
  Description of Artificial Sequence: Synthetic peptide
  Seed: GTLISRALVVTHTYLEPGPVTAQ (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGPVTAQ

SEQ ID NO: 328488 - protein, 23 aa, Artificial Sequence
  Description of Artificial Sequence: Synthetic peptide
  Seed: GTLISRALVVTHTYLEPGPVTAQ (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXPVTAQ

SEQ ID NO: 328489 - protein, 23 aa, Artificial Sequence
  Description of Artificial Sequence: Synthetic peptide
  Seed: GTLISRALVVTHTYLEPGPVTAQ (PMEL_HUMAN)
  Core: HTYLEPGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVVTXTYXEXGPXTAQ

SEQ ID NO: 328490 - protein, 24 aa, Artificial Sequence
  Description of Artificial Sequence: Synthetic peptide
  Seed: GTLISRALVVTHTYLEPGPVTAQV (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGPVTAQV

SEQ ID NO: 328491 - protein, 24 aa, Artificial Sequence
  Description of Artificial Sequence: Synthetic peptide
  Seed: GTLISRALVVTHTYLEPGPVTAQV (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGPVTAQV

SEQ ID NO: 328492 - protein, 24 aa, Artificial Sequence
  Description of Artificial Sequence: Synthetic peptide
  Seed: GTLISRALVVTHTYLEPGPVTAQV (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGPVTAQV

SEQ ID NO: 328493 - protein, 24 aa, Artificial Sequence
  Description of Artificial Sequence: Synthetic peptide
  Seed: GTLISRALVVTHTYLEPGPVTAQV (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGPVTAQV

SEQ ID NO: 328494 - protein, 24 aa, Artificial Sequence
  Description of Artificial Sequence: Synthetic peptide
  Seed: GTLISRALVVTHTYLEPGPVTAQV (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXPVTAQV

SEQ ID NO: 328495 - protein, 24 aa, Artificial Sequence
  Description of Artificial Sequence: Synthetic peptide
  Seed: GTLISRALVVTHTYLEPGPVTAQV (PMEL_HUMAN)
  Core: HTYLEPGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVVTXTYXEXGPXTAQV

SEQ ID NO: 328496 - protein, 25 aa, Artificial Sequence
  Description of Artificial Sequence: Synthetic peptide
  Seed: GTLISRALVVTHTYLEPGPVTAQVV (PMEL_HUMAN)
  Core: SRALVVTHT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTLIXRAXVXTHXYLEPGPVTAQVV

SEQ ID NO: 328497 - protein, 25 aa, Artificial Sequence
  Description of Artificial Sequence: Synthetic peptide
  Seed: GTLISRALVVTHTYLEPGPVTAQVV (PMEL_HUMAN)
  Core: RALVVTHTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTLISXALXVXHTXLEPGPVTAQVV

SEQ ID NO: 328498 - protein, 25 aa, Artificial Sequence
  Description of Artificial Sequence: Synthetic peptide
  Seed: GTLISRALVVTHTYLEPGPVTAQVV (PMEL_HUMAN)
  Core: LVVTHTYLE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRAXVVXHXYLXPGPVTAQVV

SEQ ID NO: 328499 - protein, 25 aa, Artificial Sequence
  Description of Artificial Sequence: Synthetic peptide
  Seed: GTLISRALVVTHTYLEPGPVTAQVV (PMEL_HUMAN)
  Core: VVTHTYLEP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALXVTXTXLEXGPVTAQVV

SEQ ID NO: 328500 - protein, 25 aa, Artificial Sequence
  Description of Artificial Sequence: Synthetic peptide
  Seed: GTLISRALVVTHTYLEPGPVTAQVV (PMEL_HUMAN)
  Core: VTHTYLEPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVXTHXYXEPXPVTAQVV

SEQ ID NO: 328501 - protein, 25 aa, Artificial Sequence
  Description of Artificial Sequence: Synthetic peptide
  Seed: GTLISRALVVTHTYLEPGPVTAQVV (PMEL_HUMAN)
  Core: HTYLEPGPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTLISRALVVTXTYXEXGPXTAQVV

SEQ ID NO: 328502 - protein, 13 aa, Artificial Sequence
  Description of Artificial Sequence: Synthetic peptide
  Seed: GTTAAQVTTTEWV (PMEL_HUMAN)
  Core: TTAAQVTTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTAXQXTTXEWV

SEQ ID NO: 328503 - protein, 14 aa, Artificial Sequence
  Description of Artificial Sequence: Synthetic peptide
  Seed: GTTAAQVTTTEWVE (PMEL_HUMAN)
  Core: TTAAQVTTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTAXQXTTXEWVE

SEQ ID NO: 328504 - protein, 15 aa, Artificial Sequence
  Description of Artificial Sequence: Synthetic peptide
  Seed: GTTAAQVTTTEWVET (PMEL_HUMAN)
  Core: TTAAQVTTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTAXQXTTXEWVET

SEQ ID NO: 328505 - protein, 16 aa, Artificial Sequence
  Description of Artificial Sequence: Synthetic peptide
  Seed: GTTAAQVTTTEWVETT (PMEL_HUMAN)
  Core: TTAAQVTTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTAXQXTTXEWVETT

SEQ ID NO: 328506 - protein, 17 aa, Artificial Sequence
  Description of Artificial Sequence: Synthetic peptide
  Seed: GTTAAQVTTTEWVETTA (PMEL_HUMAN)
  Core: TTAAQVTTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTAXQXTTXEWVETTA

SEQ ID NO: 328507 - protein, 18 aa, Artificial Sequence
  Description of Artificial Sequence: Synthetic peptide
  Seed: GTTAAQVTTTEWVETTAR (PMEL_HUMAN)
  Core: TTTEWVETT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVXTTXWXETXAR

SEQ ID NO: 328508 - protein, 19 aa, Artificial Sequence
  Description of Artificial Sequence: Synthetic peptide
  Seed: GTTAAQVTTTEWVETTARE (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTARE

SEQ ID NO: 328509 - protein, 19 aa, Artificial Sequence
  Description of Artificial Sequence: Synthetic peptide
  Seed: GTTAAQVTTTEWVETTARE (PMEL_HUMAN)
  Core: TTTEWVETT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVXTTXWXETXARE

SEQ ID NO: 328510 - protein, 20 aa, Artificial Sequence
  Description of Artificial Sequence: Synthetic peptide
  Seed: GTTAAQVTTTEWVETTAREL (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTAREL

SEQ ID NO: 328511 - protein, 20 aa, Artificial Sequence
  Description of Artificial Sequence: Synthetic peptide
  Seed: GTTAAQVTTTEWVETTAREL (PMEL_HUMAN)
  Core: TTTEWVETT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVXTTXWXETXAREL

SEQ ID NO: 328512 - protein, 20 aa, Artificial Sequence
  Description of Artificial Sequence: Synthetic peptide
  Seed: GTTAAQVTTTEWVETTAREL (PMEL_HUMAN)
  Core: TTEWVETTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTXTEXVXTTXREL

SEQ ID NO: 328513 - protein, 20 aa, Artificial Sequence
  Description of Artificial Sequence: Synthetic peptide
  Seed: GTTAAQVTTTEWVETTAREL (PMEL_HUMAN)
  Core: WVETTAREL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEXVEXTXREX

SEQ ID NO: 328514 - protein, 21 aa, Artificial Sequence
  Description of Artificial Sequence: Synthetic peptide
  Seed: GTTAAQVTTTEWVETTARELP (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTARELP

SEQ ID NO: 328515 - protein, 21 aa, Artificial Sequence
  Description of Artificial Sequence: Synthetic peptide
  Seed: GTTAAQVTTTEWVETTARELP (PMEL_HUMAN)
  Core: TTTEWVETT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVXTTXWXETXARELP

SEQ ID NO: 328516 - protein, 21 aa, Artificial Sequence
  Description of Artificial Sequence: Synthetic peptide
  Seed: GTTAAQVTTTEWVETTARELP (PMEL_HUMAN)
  Core: WVETTAREL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEXVEXTXREXP

SEQ ID NO: 328517 - protein, 22 aa, Artificial Sequence
  Description of Artificial Sequence: Synthetic peptide
  Seed: GTTAAQVTTTEWVETTARELPI (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTARELPI

SEQ ID NO: 328518 - protein, 22 aa, Artificial Sequence
  Description of Artificial Sequence: Synthetic peptide
  Seed: GTTAAQVTTTEWVETTARELPI (PMEL_HUMAN)
  Core: TTTEWVETT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVXTTXWXETXARELPI

SEQ ID NO: 328519 - protein, 22 aa, Artificial Sequence
  Description of Artificial Sequence: Synthetic peptide
  Seed: GTTAAQVTTTEWVETTARELPI (PMEL_HUMAN)
  Core: WVETTAREL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEXVEXTXREXPI

SEQ ID NO: 328520 - protein, 23 aa, Artificial Sequence
  Description of Artificial Sequence: Synthetic peptide
  Seed: GTTAAQVTTTEWVETTARELPIP (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTARELPIP

SEQ ID NO: 328521 - protein, 23 aa, Artificial Sequence
  Description of Artificial Sequence: Synthetic peptide
  Seed: GTTAAQVTTTEWVETTARELPIP (PMEL_HUMAN)
  Core: WVETTAREL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEXVEXTXREXPIP

SEQ ID NO: 328522 - protein, 24 aa, Artificial Sequence
  Description of Artificial Sequence: Synthetic peptide
  Seed: GTTAAQVTTTEWVETTARELPIPE (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTARELPIPE

SEQ ID NO: 328523 - protein, 24 aa, Artificial Sequence
  Description of Artificial Sequence: Synthetic peptide
  Seed: GTTAAQVTTTEWVETTARELPIPE (PMEL_HUMAN)
  Core: WVETTAREL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEXVEXTXREXPIPE

SEQ ID NO: 328524 - protein, 24 aa, Artificial Sequence
  Description of Artificial Sequence: Synthetic peptide
  Seed: GTTAAQVTTTEWVETTARELPIPE (PMEL_HUMAN)
  Core: ETTARELPI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEWVXTTXRXLPXPE

SEQ ID NO: 328525 - protein, 25 aa, Artificial Sequence
  Description of Artificial Sequence: Synthetic peptide
  Seed: GTTAAQVTTTEWVETTARELPIPEP (PMEL_HUMAN)
  Core: VTTTEWVET
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQXTTXEXVEXTARELPIPEP

SEQ ID NO: 328526 - protein, 25 aa, Artificial Sequence
  Description of Artificial Sequence: Synthetic peptide
  Seed: GTTAAQVTTTEWVETTARELPIPEP (PMEL_HUMAN)
  Core: WVETTAREL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEXVEXTXREXPIPEP

SEQ ID NO: 328527 - protein, 25 aa, Artificial Sequence
  Description of Artificial Sequence: Synthetic peptide
  Seed: GTTAAQVTTTEWVETTARELPIPEP (PMEL_HUMAN)
  Core: ETTARELPI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
GTTAAQVTTTEWVXTTXRXLPXPEP

SEQ ID NO: 328528 - protein, 23 aa, Artificial Sequence
  Description of Artificial Sequence: Synthetic peptide
  Seed: GTTDGHRPTAEAPNTTAGQVPTT (PMEL_HUMAN)
  Core: PTAEAPNTT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTDGHRXTAXAXNTXAGQVPTT

SEQ ID NO: 328529 - protein, 24 aa, Artificial Sequence
  Description of Artificial Sequence: Synthetic peptide
  Seed: GTTDGHRPTAEAPNTTAGQVPTTE (PMEL_HUMAN)
  Core: TTAGQVPTT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GTTDGHRPTAEAPNXTAXQXPTXE

SEQ ID NO: 328530 - protein, 25 aa, Artificial Sequence
  Description of Artificial Sequence: Synthetic peptide
  Seed: GTTDGHRPTAEAPNTTAGQVPTTEV (PMEL_HUMAN)
  Core: TTAGQVPTT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GTTDGHRPTAEAPNXTAXQXPTXEV

SEQ ID NO: 328531 - protein, 14 aa, Artificial Sequence
  Description of Artificial Sequence: Synthetic peptide
  Seed: GTTLAEMSTPEATG (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTG

SEQ ID NO: 328532 - protein, 14 aa, Artificial Sequence
  Description of Artificial Sequence: Synthetic peptide
  Seed: GTTLAEMSTPEATG (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXG

SEQ ID NO: 328533 - protein, 15 aa, Artificial Sequence
  Description of Artificial Sequence: Synthetic peptide
  Seed: GTTLAEMSTPEATGM (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGM

SEQ ID NO: 328534 - protein, 15 aa, Artificial Sequence
  Description of Artificial Sequence: Synthetic peptide
  Seed: GTTLAEMSTPEATGM (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGM

SEQ ID NO: 328535 - protein, 16 aa, Artificial Sequence
  Description of Artificial Sequence: Synthetic peptide
  Seed: GTTLAEMSTPEATGMT (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMT

SEQ ID NO: 328536 - protein, 16 aa, Artificial Sequence
  Description of Artificial Sequence: Synthetic peptide
  Seed: GTTLAEMSTPEATGMT (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMT

SEQ ID NO: 328537 - protein, 17 aa, Artificial Sequence
  Description of Artificial Sequence: Synthetic peptide
  Seed: GTTLAEMSTPEATGMTP (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTP

SEQ ID NO: 328538 - protein, 17 aa, Artificial Sequence
  Description of Artificial Sequence: Synthetic peptide
  Seed: GTTLAEMSTPEATGMTP (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMTP

SEQ ID NO: 328539 - protein, 18 aa, Artificial Sequence
  Description of Artificial Sequence: Synthetic peptide
  Seed: GTTLAEMSTPEATGMTPA (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMTPA

SEQ ID NO: 328540 - protein, 19 aa, Artificial Sequence
  Description of Artificial Sequence: Synthetic peptide
  Seed: GTTLAEMSTPEATGMTPAE (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMTPAE

SEQ ID NO: 328541 - protein, 20 aa, Artificial Sequence
  Description of Artificial Sequence: Synthetic peptide
  Seed: GTTLAEMSTPEATGMTPAEV (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTPAEV

SEQ ID NO: 328542 - protein, 20 aa, Artificial Sequence
  Description of Artificial Sequence: Synthetic peptide
  Seed: GTTLAEMSTPEATGMTPAEV (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMTPAEV

SEQ ID NO: 328543 - protein, 20 aa, Artificial Sequence
  Description of Artificial Sequence: Synthetic peptide
  Seed: GTTLAEMSTPEATGMTPAEV (PMEL_HUMAN)
  Core: ATGMTPAEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEXTGXTXAEX

SEQ ID NO: 328544 - protein, 21 aa, Artificial Sequence
  Description of Artificial Sequence: Synthetic peptide
  Seed: GTTLAEMSTPEATGMTPAEVS (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTPAEVS

SEQ ID NO: 328545 - protein, 21 aa, Artificial Sequence
  Description of Artificial Sequence: Synthetic peptide
  Seed: GTTLAEMSTPEATGMTPAEVS (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMTPAEVS

SEQ ID NO: 328546 - protein, 21 aa, Artificial Sequence
  Description of Artificial Sequence: Synthetic peptide
  Seed: GTTLAEMSTPEATGMTPAEVS (PMEL_HUMAN)
  Core: ATGMTPAEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEXTGXTXAEXS

SEQ ID NO: 328547 - protein, 22 aa, Artificial Sequence
  Description of Artificial Sequence: Synthetic peptide
  Seed: GTTLAEMSTPEATGMTPAEVSI (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTPAEVSI

SEQ ID NO: 328548 - protein, 22 aa, Artificial Sequence
  Description of Artificial Sequence: Synthetic peptide
  Seed: GTTLAEMSTPEATGMTPAEVSI (PMEL_HUMAN)
  Core: AEMSTPEAT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTLXEMXTXEAXGMTPAEVSI

SEQ ID NO: 328549 - protein, 22 aa, Artificial Sequence
  Description of Artificial Sequence: Synthetic peptide
  Seed: GTTLAEMSTPEATGMTPAEVSI (PMEL_HUMAN)
  Core: ATGMTPAEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEXTGXTXAEXSI

SEQ ID NO: 328550 - protein, 23 aa, Artificial Sequence
  Description of Artificial Sequence: Synthetic peptide
  Seed: GTTLAEMSTPEATGMTPAEVSIV (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTPAEVSIV

SEQ ID NO: 328551 - protein, 23 aa, Artificial Sequence
  Description of Artificial Sequence: Synthetic peptide
  Seed: GTTLAEMSTPEATGMTPAEVSIV (PMEL_HUMAN)
  Core: EATGMTPAE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPXATXMXPAXVSIV

SEQ ID NO: 328552 - protein, 23 aa, Artificial Sequence
  Description of Artificial Sequence: Synthetic peptide
  Seed: GTTLAEMSTPEATGMTPAEVSIV (PMEL_HUMAN)
  Core: ATGMTPAEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEXTGXTXAEXSIV

SEQ ID NO: 328553 - protein, 24 aa, Artificial Sequence
  Description of Artificial Sequence: Synthetic peptide
  Seed: GTTLAEMSTPEATGMTPAEVSIVV (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTPAEVSIVV

SEQ ID NO: 328554 - protein, 24 aa, Artificial Sequence
  Description of Artificial Sequence: Synthetic peptide
  Seed: GTTLAEMSTPEATGMTPAEVSIVV (PMEL_HUMAN)
  Core: EATGMTPAE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPXATXMXPAXVSIVV

SEQ ID NO: 328555 - protein, 24 aa, Artificial Sequence
  Description of Artificial Sequence: Synthetic peptide
  Seed: GTTLAEMSTPEATGMTPAEVSIVV (PMEL_HUMAN)
  Core: ATGMTPAEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEXTGXTXAEXSIVV

SEQ ID NO: 328556 - protein, 25 aa, Artificial Sequence
  Description of Artificial Sequence: Synthetic peptide
  Seed: GTTLAEMSTPEATGMTPAEVSIVVL (PMEL_HUMAN)
  Core: LAEMSTPEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTTXAEXSXPEXTGMTPAEVSIVVL

SEQ ID NO: 328557 - protein, 25 aa, Artificial Sequence
  Description of Artificial Sequence: Synthetic peptide
  Seed: GTTLAEMSTPEATGMTPAEVSIVVL (PMEL_HUMAN)
  Core: ATGMTPAEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEXTGXTXAEXSIVVL

SEQ ID NO: 328558 - protein, 25 aa, Artificial Sequence
  Description of Artificial Sequence: Synthetic peptide
  Seed: GTTLAEMSTPEATGMTPAEVSIVVL (PMEL_HUMAN)
  Core: MTPAEVSIV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GTTLAEMSTPEATGXTPXEXSIXVL

SEQ ID NO: 328559 - protein, 15 aa, Artificial Sequence
  Description of Artificial Sequence: Synthetic peptide
  Seed: GTTPGQAPTAEPSGT (PMEL_HUMAN)
  Core: TTPGQAPTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXQXPTXEPSGT

SEQ ID NO: 328560 - protein, 16 aa, Artificial Sequence
  Description of Artificial Sequence: Synthetic peptide
  Seed: GTTPGQAPTAEPSGTT (PMEL_HUMAN)
  Core: TTPGQAPTA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTPXQXPTXEPSGTT

SEQ ID NO: 328561 - protein, 20 aa, Artificial Sequence
  Description of Artificial Sequence: Synthetic peptide
  Seed: GTTPGQAPTAEPSGTTSVQV (PMEL_HUMAN)
  Core: APTAEPSGT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTTPGQXPTXEXSGXTSVQV

SEQ ID NO: 328562 - protein, 21 aa, Artificial Sequence
  Description of Artificial Sequence: Synthetic peptide
  Seed: GTTPGQAPTAEPSGTTSVQVP (PMEL_HUMAN)
  Core: PSGTTSVQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTPGQAPTAEXSGXTXVQXP

SEQ ID NO: 328563 - protein, 22 aa, Artificial Sequence
  Description of Artificial Sequence: Synthetic peptide
  Seed: GTTPGQAPTAEPSGTTSVQVPT (PMEL_HUMAN)
  Core: PSGTTSVQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTPGQAPTAEXSGXTXVQXPT

SEQ ID NO: 328564 - protein, 23 aa, Artificial Sequence
  Description of Artificial Sequence: Synthetic peptide
  Seed: GTTPGQAPTAEPSGTTSVQVPTT (PMEL_HUMAN)
  Core: PSGTTSVQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTPGQAPTAEXSGXTXVQXPTT

SEQ ID NO: 328565 - protein, 24 aa, Artificial Sequence
  Description of Artificial Sequence: Synthetic peptide
  Seed: GTTPGQAPTAEPSGTTSVQVPTTE (PMEL_HUMAN)
  Core: PSGTTSVQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTPGQAPTAEXSGXTXVQXPTTE

SEQ ID NO: 328566 - protein, 25 aa, Artificial Sequence
  Description of Artificial Sequence: Synthetic peptide
  Seed: GTTPGQAPTAEPSGTTSVQVPTTEV (PMEL_HUMAN)
  Core: PSGTTSVQV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTPGQAPTAEXSGXTXVQXPTTEV

SEQ ID NO: 328567 - protein, 15 aa, Artificial Sequence
  Description of Artificial Sequence: Synthetic peptide
  Seed: GTTSVQVPTTEVIST (PMEL_HUMAN)
  Core: TTSVQVPTT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXTSXQXPTXEVIST

SEQ ID NO: 328568 - protein, 16 aa, Artificial Sequence
  Description of Artificial Sequence: Synthetic peptide
  Seed: GTTSVQVPTTEVISTA (PMEL_HUMAN)
  Core: PTTEVISTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVXTTXVXSTX

SEQ ID NO: 328569 - protein, 17 aa, Artificial Sequence
  Description of Artificial Sequence: Synthetic peptide
  Seed: GTTSVQVPTTEVISTAP (PMEL_HUMAN)
  Core: PTTEVISTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVXTTXVXSTXP

SEQ ID NO: 328570 - protein, 19 aa, Artificial Sequence
  Description of Artificial Sequence: Synthetic peptide
  Seed: GTTSVQVPTTEVISTAPVQ (PMEL_HUMAN)
  Core: PTTEVISTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVXTTXVXSTXPVQ

SEQ ID NO: 328571 - protein, 20 aa, Artificial Sequence
  Description of Artificial Sequence: Synthetic peptide
  Seed: GTTSVQVPTTEVISTAPVQM (PMEL_HUMAN)
  Core: VQVPTTEVI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTTSXQVXTXEVXSTAPVQM

SEQ ID NO: 328572 - protein, 20 aa, Artificial Sequence
  Description of Artificial Sequence: Synthetic peptide
  Seed: GTTSVQVPTTEVISTAPVQM (PMEL_HUMAN)
  Core: QVPTTEVIS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVXVPXTXVIXTAPVQM

SEQ ID NO: 328573 - protein, 20 aa, Artificial Sequence
  Description of Artificial Sequence: Synthetic peptide
  Seed: GTTSVQVPTTEVISTAPVQM (PMEL_HUMAN)
  Core: PTTEVISTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVXTTXVXSTXPVQM

SEQ ID NO: 328574 - protein, 20 aa, Artificial Sequence
  Description of Artificial Sequence: Synthetic peptide
  Seed: GTTSVQVPTTEVISTAPVQM (PMEL_HUMAN)
  Core: TEVISTAPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTXEVXSXAPXQM

SEQ ID NO: 328575 - protein, 20 aa, Artificial Sequence
  Description of Artificial Sequence: Synthetic peptide
  Seed: GTTSVQVPTTEVISTAPVQM (PMEL_HUMAN)
  Core: VISTAPVQM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEXISXAXVQX

SEQ ID NO: 328576 - protein, 21 aa, Artificial Sequence
  Description of Artificial Sequence: Synthetic peptide
  Seed: GTTSVQVPTTEVISTAPVQMP (PMEL_HUMAN)
  Core: PTTEVISTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVXTTXVXSTXPVQMP

SEQ ID NO: 328577 - protein, 21 aa, Artificial Sequence
  Description of Artificial Sequence: Synthetic peptide
  Seed: GTTSVQVPTTEVISTAPVQMP (PMEL_HUMAN)
  Core: TEVISTAPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTXEVXSXAPXQMP

SEQ ID NO: 328578 - protein, 21 aa, Artificial Sequence
  Description of Artificial Sequence: Synthetic peptide
  Seed: GTTSVQVPTTEVISTAPVQMP (PMEL_HUMAN)
  Core: VISTAPVQM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEXISXAXVQXP

SEQ ID NO: 328579 - protein, 22 aa, Artificial Sequence
  Description of Artificial Sequence: Synthetic peptide
  Seed: GTTSVQVPTTEVISTAPVQMPT (PMEL_HUMAN)
  Core: TEVISTAPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTXEVXSXAPXQMPT

SEQ ID NO: 328580 - protein, 22 aa, Artificial Sequence
  Description of Artificial Sequence: Synthetic peptide
  Seed: GTTSVQVPTTEVISTAPVQMPT (PMEL_HUMAN)
  Core: VISTAPVQM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEXISXAXVQXPT

SEQ ID NO: 328581 - protein, 23 aa, Artificial Sequence
  Description of Artificial Sequence: Synthetic peptide
  Seed: GTTSVQVPTTEVISTAPVQMPTA (PMEL_HUMAN)
  Core: VISTAPVQM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEXISXAXVQXPTA

SEQ ID NO: 328582 - protein, 23 aa, Artificial Sequence
  Description of Artificial Sequence: Synthetic peptide
  Seed: GTTSVQVPTTEVISTAPVQMPTA (PMEL_HUMAN)
  Core: ISTAPVQMP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEVXSTXPXQMXTA

SEQ ID NO: 328583 - protein, 24 aa, Artificial Sequence
  Description of Artificial Sequence: Synthetic peptide
  Seed: GTTSVQVPTTEVISTAPVQMPTAE (PMEL_HUMAN)
  Core: VISTAPVQM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEXISXAXVQXPTAE

SEQ ID NO: 328584 - protein, 24 aa, Artificial Sequence
  Description of Artificial Sequence: Synthetic peptide
  Seed: GTTSVQVPTTEVISTAPVQMPTAE (PMEL_HUMAN)
  Core: ISTAPVQMP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEVXSTXPXQMXTAE

SEQ ID NO: 328585 - protein, 25 aa, Artificial Sequence
  Description of Artificial Sequence: Synthetic peptide
  Seed: GTTSVQVPTTEVISTAPVQMPTAES (PMEL_HUMAN)
  Core: VISTAPVQM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEXISXAXVQXPTAES

SEQ ID NO: 328586 - protein, 25 aa, Artificial Sequence
  Description of Artificial Sequence: Synthetic peptide
  Seed: GTTSVQVPTTEVISTAPVQMPTAES (PMEL_HUMAN)
  Core: ISTAPVQMP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTTSVQVPTTEVXSTXPXQMXTAES

SEQ ID NO: 328587 - protein, 14 aa, Artificial Sequence
  Description of Artificial Sequence: Synthetic peptide
  Seed: GTYCLNVSLADTNS (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNS

SEQ ID NO: 328588 - protein, 14 aa, Artificial Sequence
  Description of Artificial Sequence: Synthetic peptide
  Seed: GTYCLNVSLADTNS (PMEL_HUMAN)
  Core: CLNVSLADT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
GTYXLNXSXADXNS

SEQ ID NO: 328589 - protein, 15 aa, Artificial Sequence
  Description of Artificial Sequence: Synthetic peptide
  Seed: GTYCLNVSLADTNSL (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSL

SEQ ID NO: 328590 - protein, 15 aa, Artificial Sequence
  Description of Artificial Sequence: Synthetic peptide
  Seed: GTYCLNVSLADTNSL (PMEL_HUMAN)
  Core: LNVSLADTN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTYCXNVXLXDTXSL

SEQ ID NO: 328591 - protein, 15 aa, Artificial Sequence
  Description of Artificial Sequence: Synthetic peptide
  Seed: GTYCLNVSLADTNSL (PMEL_HUMAN)
  Core: NVSLADTNS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLXVSXAXTNXL

SEQ ID NO: 328592 - protein, 16 aa, Artificial Sequence
  Description of Artificial Sequence: Synthetic peptide
  Seed: GTYCLNVSLADTNSLA (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLA

SEQ ID NO: 328593 - protein, 16 aa, Artificial Sequence
  Description of Artificial Sequence: Synthetic peptide
  Seed: GTYCLNVSLADTNSLA (PMEL_HUMAN)
  Core: LNVSLADTN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTYCXNVXLXDTXSLA

SEQ ID NO: 328594 - protein, 16 aa, Artificial Sequence
  Description of Artificial Sequence: Synthetic peptide
  Seed: GTYCLNVSLADTNSLA (PMEL_HUMAN)
  Core: NVSLADTNS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLXVSXAXTNXLA

SEQ ID NO: 328595 - protein, 16 aa, Artificial Sequence
  Description of Artificial Sequence: Synthetic peptide
  Seed: GTYCLNVSLADTNSLA (PMEL_HUMAN)
  Core: VSLADTNSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNXSLXDXNSXA

SEQ ID NO: 328596 - protein, 17 aa, Artificial Sequence
  Description of Artificial Sequence: Synthetic peptide
  Seed: GTYCLNVSLADTNSLAV (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAV

SEQ ID NO: 328597 - protein, 17 aa, Artificial Sequence
  Description of Artificial Sequence: Synthetic peptide
  Seed: GTYCLNVSLADTNSLAV (PMEL_HUMAN)
  Core: LNVSLADTN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GTYCXNVXLXDTXSLAV

SEQ ID NO: 328598 - protein, 17 aa, Artificial Sequence
  Description of Artificial Sequence: Synthetic peptide
  Seed: GTYCLNVSLADTNSLAV (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAX

SEQ ID NO: 328599 - protein, 18 aa, Artificial Sequence
  Description of Artificial Sequence: Synthetic peptide
  Seed: GTYCLNVSLADTNSLAVV (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXV

SEQ ID NO: 328600 - protein, 19 aa, Artificial Sequence
  Description of Artificial Sequence: Synthetic peptide
  Seed: GTYCLNVSLADTNSLAVVS (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVS

SEQ ID NO: 328601 - protein, 19 aa, Artificial Sequence
  Description of Artificial Sequence: Synthetic peptide
  Seed: GTYCLNVSLADTNSLAVVS (PMEL_HUMAN)
  Core: VSLADTNSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNXSLXDXNSXAVVS

SEQ ID NO: 328602 - protein, 19 aa, Artificial Sequence
  Description of Artificial Sequence: Synthetic peptide
  Seed: GTYCLNVSLADTNSLAVVS (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVS

SEQ ID NO: 328603 - protein, 20 aa, Artificial Sequence
  Description of Artificial Sequence: Synthetic peptide
  Seed: GTYCLNVSLADTNSLAVVST (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVST

SEQ ID NO: 328604 - protein, 20 aa, Artificial Sequence
  Description of Artificial Sequence: Synthetic peptide
  Seed: GTYCLNVSLADTNSLAVVST (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVST

SEQ ID NO: 328605 - protein, 20 aa, Artificial Sequence
  Description of Artificial Sequence: Synthetic peptide
  Seed: GTYCLNVSLADTNSLAVVST (PMEL_HUMAN)
  Core: DTNSLAVVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLAXTNXLXVVXT

SEQ ID NO: 328606 - protein, 21 aa, Artificial Sequence
  Description of Artificial Sequence: Synthetic peptide
  Seed: GTYCLNVSLADTNSLAVVSTQ (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVSTQ

SEQ ID NO: 328607 - protein, 21 aa, Artificial Sequence
  Description of Artificial Sequence: Synthetic peptide
  Seed: GTYCLNVSLADTNSLAVVSTQ (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVSTQ

SEQ ID NO: 328608 - protein, 21 aa, Artificial Sequence
  Description of Artificial Sequence: Synthetic peptide
  Seed: GTYCLNVSLADTNSLAVVSTQ (PMEL_HUMAN)
  Core: DTNSLAVVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLAXTNXLXVVXTQ

SEQ ID NO: 328609 - protein, 22 aa, Artificial Sequence
  Description of Artificial Sequence: Synthetic peptide
  Seed: GTYCLNVSLADTNSLAVVSTQL (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVSTQL

SEQ ID NO: 328610 - protein, 22 aa, Artificial Sequence
  Description of Artificial Sequence: Synthetic peptide
  Seed: GTYCLNVSLADTNSLAVVSTQL (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVSTQL

SEQ ID NO: 328611 - protein, 22 aa, Artificial Sequence
  Description of Artificial Sequence: Synthetic peptide
  Seed: GTYCLNVSLADTNSLAVVSTQL (PMEL_HUMAN)
  Core: DTNSLAVVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLAXTNXLXVVXTQL

SEQ ID NO: 328612 - protein, 22 aa, Artificial Sequence
  Description of Artificial Sequence: Synthetic peptide
  Seed: GTYCLNVSLADTNSLAVVSTQL (PMEL_HUMAN)
  Core: NSLAVVSTQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLADTXSLXVXSTXL

SEQ ID NO: 328613 - protein, 23 aa, Artificial Sequence
  Description of Artificial Sequence: Synthetic peptide
  Seed: GTYCLNVSLADTNSLAVVSTQLI (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVSTQLI

SEQ ID NO: 328614 - protein, 23 aa, Artificial Sequence
  Description of Artificial Sequence: Synthetic peptide
  Seed: GTYCLNVSLADTNSLAVVSTQLI (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVSTQLI

SEQ ID NO: 328615 - protein, 23 aa, Artificial Sequence
  Description of Artificial Sequence: Synthetic peptide
  Seed: GTYCLNVSLADTNSLAVVSTQLI (PMEL_HUMAN)
  Core: DTNSLAVVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLAXTNXLXVVXTQLI

SEQ ID NO: 328616 - protein, 23 aa, Artificial Sequence
  Description of Artificial Sequence: Synthetic peptide
  Seed: GTYCLNVSLADTNSLAVVSTQLI (PMEL_HUMAN)
  Core: NSLAVVSTQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLADTXSLXVXSTXLI

SEQ ID NO: 328617 - protein, 24 aa, Artificial Sequence
  Description of Artificial Sequence: Synthetic peptide
  Seed: GTYCLNVSLADTNSLAVVSTQLIM (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVSTQLIM

SEQ ID NO: 328618 - protein, 24 aa, Artificial Sequence
  Description of Artificial Sequence: Synthetic peptide
  Seed: GTYCLNVSLADTNSLAVVSTQLIM (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVSTQLIM

SEQ ID NO: 328619 - protein, 24 aa, Artificial Sequence
  Description of Artificial Sequence: Synthetic peptide
  Seed: GTYCLNVSLADTNSLAVVSTQLIM (PMEL_HUMAN)
  Core: DTNSLAVVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLAXTNXLXVVXTQLIM

SEQ ID NO: 328620 - protein, 24 aa, Artificial Sequence
  Description of Artificial Sequence: Synthetic peptide
  Seed: GTYCLNVSLADTNSLAVVSTQLIM (PMEL_HUMAN)
  Core: NSLAVVSTQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLADTXSLXVXSTXLIM

SEQ ID NO: 328621 - protein, 25 aa, Artificial Sequence
  Description of Artificial Sequence: Synthetic peptide
  Seed: GTYCLNVSLADTNSLAVVSTQLIMP (PMEL_HUMAN)
  Core: YCLNVSLAD
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
GTXCLXVXLAXTNSLAVVSTQLIMP

SEQ ID NO: 328622 - protein, 25 aa, Artificial Sequence
  Description of Artificial Sequence: Synthetic peptide
  Seed: GTYCLNVSLADTNSLAVVSTQLIMP (PMEL_HUMAN)
  Core: LADTNSLAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSXADXNXLAXVSTQLIMP

SEQ ID NO: 328623 - protein, 25 aa, Artificial Sequence
  Description of Artificial Sequence: Synthetic peptide
  Seed: GTYCLNVSLADTNSLAVVSTQLIMP (PMEL_HUMAN)
  Core: DTNSLAVVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLAXTNXLXVVXTQLIMP

SEQ ID NO: 328624 - protein, 25 aa, Artificial Sequence
  Description of Artificial Sequence: Synthetic peptide
  Seed: GTYCLNVSLADTNSLAVVSTQLIMP (PMEL_HUMAN)
  Core: NSLAVVSTQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLADTXSLXVXSTXLIMP

SEQ ID NO: 328625 - protein, 25 aa, Artificial Sequence
  Description of Artificial Sequence: Synthetic peptide
  Seed: GTYCLNVSLADTNSLAVVSTQLIMP (PMEL_HUMAN)
  Core: LAVVSTQLI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GTYCLNVSLADTNSXAVXSXQLXMP

SEQ ID NO: 328626 - protein, 14 aa, Artificial Sequence
  Description of Artificial Sequence: Synthetic peptide
  Seed: GVSRQLRTKAWNRQ (PMEL_HUMAN)
  Core: VSRQLRTKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXSRXLXTKXWNRQ

SEQ ID NO: 328627 - protein, 15 aa, Artificial Sequence
  Description of Artificial Sequence: Synthetic peptide
  Seed: GVSRQLRTKAWNRQL (PMEL_HUMAN)
  Core: VSRQLRTKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXSRXLXTKXWNRQL

SEQ ID NO: 328628 - protein, 15 aa, Artificial Sequence
  Description of Artificial Sequence: Synthetic peptide
  Seed: GVSRQLRTKAWNRQL (PMEL_HUMAN)
  Core: QLRTKAWNR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
GVSRXLRXKXWNXQL

SEQ ID NO: 328629 - protein, 15 aa, Artificial Sequence
  Description of Artificial Sequence: Synthetic peptide
  Seed: GVSRQLRTKAWNRQL (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXL

SEQ ID NO: 328630 - protein, 16 aa, Artificial Sequence
  Description of Artificial Sequence: Synthetic peptide
  Seed: GVSRQLRTKAWNRQLY (PMEL_HUMAN)
  Core: VSRQLRTKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
GXSRXLXTKXWNRQLY

SEQ ID NO: 328631 - protein, 16 aa, Artificial Sequence
  Description of Artificial Sequence: Synthetic peptide
  Seed: GVSRQLRTKAWNRQLY (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLY

SEQ ID NO: 328632 - protein, 16 aa, Artificial Sequence
  Description of Artificial Sequence: Synthetic peptide
  Seed: GVSRQLRTKAWNRQLY (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLX

SEQ ID NO: 328633 - protein, 17 aa, Artificial Sequence
  Description of Artificial Sequence: Synthetic peptide
  Seed: GVSRQLRTKAWNRQLYP (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYP

SEQ ID NO: 328634 - protein, 17 aa, Artificial Sequence
  Description of Artificial Sequence: Synthetic peptide
  Seed: GVSRQLRTKAWNRQLYP (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXP

SEQ ID NO: 328635 - protein, 18 aa, Artificial Sequence
  Description of Artificial Sequence: Synthetic peptide
  Seed: GVSRQLRTKAWNRQLYPE (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPE

SEQ ID NO: 328636 - protein, 19 aa, Artificial Sequence
  Description of Artificial Sequence: Synthetic peptide
  Seed: GVSRQLRTKAWNRQLYPEW (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEW

SEQ ID NO: 328637 - protein, 19 aa, Artificial Sequence
  Description of Artificial Sequence: Synthetic peptide
  Seed: GVSRQLRTKAWNRQLYPEW (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEW

SEQ ID NO: 328638 - protein, 20 aa, Artificial Sequence
  Description of Artificial Sequence: Synthetic peptide
  Seed: GVSRQLRTKAWNRQLYPEWT (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEWT

SEQ ID NO: 328639 - protein, 20 aa, Artificial Sequence
  Description of Artificial Sequence: Synthetic peptide
  Seed: GVSRQLRTKAWNRQLYPEWT (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEWT

SEQ ID NO: 328640 - protein, 21 aa, Artificial Sequence
  Description of Artificial Sequence: Synthetic peptide
  Seed: GVSRQLRTKAWNRQLYPEWTE (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEWTE

SEQ ID NO: 328641 - protein, 21 aa, Artificial Sequence
  Description of Artificial Sequence: Synthetic peptide
  Seed: GVSRQLRTKAWNRQLYPEWTE (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEWTE

SEQ ID NO: 328642 - protein, 22 aa, Artificial Sequence
  Description of Artificial Sequence: Synthetic peptide
  Seed: GVSRQLRTKAWNRQLYPEWTEA (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEWTEA

SEQ ID NO: 328643 - protein, 22 aa, Artificial Sequence
  Description of Artificial Sequence: Synthetic peptide
  Seed: GVSRQLRTKAWNRQLYPEWTEA (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEWTEA

SEQ ID NO: 328644 - protein, 22 aa, Artificial Sequence
  Description of Artificial Sequence: Synthetic peptide
  Seed: GVSRQLRTKAWNRQLYPEWTEA (PMEL_HUMAN)
  Core: NRQLYPEWT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRTKAWXRQXYXEWXEA

SEQ ID NO: 328645 - protein, 23 aa, Artificial Sequence
  Description of Artificial Sequence: Synthetic peptide
  Seed: GVSRQLRTKAWNRQLYPEWTEAQ (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEWTEAQ

SEQ ID NO: 328646 - protein, 23 aa, Artificial Sequence
  Description of Artificial Sequence: Synthetic peptide
  Seed: GVSRQLRTKAWNRQLYPEWTEAQ (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEWTEAQ

SEQ ID NO: 328647 - protein, 23 aa, Artificial Sequence
  Description of Artificial Sequence: Synthetic peptide
  Seed: GVSRQLRTKAWNRQLYPEWTEAQ (PMEL_HUMAN)
  Core: NRQLYPEWT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRTKAWXRQXYXEWXEAQ

SEQ ID NO: 328648 - protein, 24 aa, Artificial Sequence
  Description of Artificial Sequence: Synthetic peptide
  Seed: GVSRQLRTKAWNRQLYPEWTEAQR (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEWTEAQR

SEQ ID NO: 328649 - protein, 24 aa, Artificial Sequence
  Description of Artificial Sequence: Synthetic peptide
  Seed: GVSRQLRTKAWNRQLYPEWTEAQR (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEWTEAQR

SEQ ID NO: 328650 - protein, 24 aa, Artificial Sequence
  Description of Artificial Sequence: Synthetic peptide
  Seed: GVSRQLRTKAWNRQLYPEWTEAQR (PMEL_HUMAN)
  Core: NRQLYPEWT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRTKAWXRQXYXEWXEAQR

SEQ ID NO: 328651 - protein, 24 aa, Artificial Sequence
  Description of Artificial Sequence: Synthetic peptide
  Seed: GVSRQLRTKAWNRQLYPEWTEAQR (PMEL_HUMAN)
  Core: LYPEWTEAQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRTKAWNRQXYPXWXEAXR

SEQ ID NO: 328652 - protein, 25 aa, Artificial Sequence
  Description of Artificial Sequence: Synthetic peptide
  Seed: GVSRQLRTKAWNRQLYPEWTEAQRL (PMEL_HUMAN)
  Core: LRTKAWNRQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQXRTXAXNRXLYPEWTEAQRL

SEQ ID NO: 328653 - protein, 25 aa, Artificial Sequence
  Description of Artificial Sequence: Synthetic peptide
  Seed: GVSRQLRTKAWNRQLYPEWTEAQRL (PMEL_HUMAN)
  Core: TKAWNRQLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRXKAXNXQLXPEWTEAQRL

SEQ ID NO: 328654 - protein, 25 aa, Artificial Sequence
  Description of Artificial Sequence: Synthetic peptide
  Seed: GVSRQLRTKAWNRQLYPEWTEAQRL (PMEL_HUMAN)
  Core: NRQLYPEWT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRTKAWXRQXYXEWXEAQRL

SEQ ID NO: 328655 - protein, 25 aa, Artificial Sequence
  Description of Artificial Sequence: Synthetic peptide
  Seed: GVSRQLRTKAWNRQLYPEWTEAQRL (PMEL_HUMAN)
  Core: LYPEWTEAQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
GVSRQLRTKAWNRQXYPXWXEAXRL

SEQ ID NO: 328656 - protein, 16 aa, Artificial Sequence
  Description of Artificial Sequence: Synthetic peptide
  Seed: GYLAEADLSYTWDFGD (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGX

SEQ ID NO: 328657 - protein, 17 aa, Artificial Sequence
  Description of Artificial Sequence: Synthetic peptide
  Seed: GYLAEADLSYTWDFGDS (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXS

SEQ ID NO: 328658 - protein, 18 aa, Artificial Sequence
  Description of Artificial Sequence: Synthetic peptide
  Seed: GYLAEADLSYTWDFGDSS (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSS

SEQ ID NO: 328659 - protein, 19 aa, Artificial Sequence
  Description of Artificial Sequence: Synthetic peptide
  Seed: GYLAEADLSYTWDFGDSSG (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSG

SEQ ID NO: 328660 - protein, 20 aa, Artificial Sequence
  Description of Artificial Sequence: Synthetic peptide
  Seed: GYLAEADLSYTWDFGDSSGT (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSGT

SEQ ID NO: 328661 - protein, 20 aa, Artificial Sequence
  Description of Artificial Sequence: Synthetic peptide
  Seed: GYLAEADLSYTWDFGDSSGT (PMEL_HUMAN)
  Core: YTWDFGDSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADLSXTWXFXDSXGT

SEQ ID NO: 328662 - protein, 21 aa, Artificial Sequence
  Description of Artificial Sequence: Synthetic peptide
  Seed: GYLAEADLSYTWDFGDSSGTL (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSGTL

SEQ ID NO: 328663 - protein, 22 aa, Artificial Sequence
  Description of Artificial Sequence: Synthetic peptide
  Seed: GYLAEADLSYTWDFGDSSGTLI (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSGTLI

SEQ ID NO: 328664 - protein, 23 aa, Artificial Sequence
  Description of Artificial Sequence: Synthetic peptide
  Seed: GYLAEADLSYTWDFGDSSGTLIS (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSGTLIS

SEQ ID NO: 328665 - protein, 24 aa, Artificial Sequence
  Description of Artificial Sequence: Synthetic peptide
  Seed: GYLAEADLSYTWDFGDSSGTLISR (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSGTLISR

SEQ ID NO: 328666 - protein, 25 aa, Artificial Sequence
  Description of Artificial Sequence: Synthetic peptide
  Seed: GYLAEADLSYTWDFGDSSGTLISRA (PMEL_HUMAN)
  Core: LSYTWDFGD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADXSYXWXFGXSSGTLISRA

SEQ ID NO: 328667 - protein, 25 aa, Artificial Sequence
  Description of Artificial Sequence: Synthetic peptide
  Seed: GYLAEADLSYTWDFGDSSGTLISRA (PMEL_HUMAN)
  Core: WDFGDSSGT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADLSYTXDFXDXSGXLISRA

SEQ ID NO: 328668 - protein, 25 aa, Artificial Sequence
  Description of Artificial Sequence: Synthetic peptide
  Seed: GYLAEADLSYTWDFGDSSGTLISRA (PMEL_HUMAN)
  Core: SSGTLISRA
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
GYLAEADLSYTWDFGDXSGXLXSRX

SEQ ID NO: 328669 - protein, 14 aa, Artificial Sequence
  Description of Artificial Sequence: Synthetic peptide
  Seed: HDPSGYLAEADLSY (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSX

SEQ ID NO: 328670 - protein, 15 aa, Artificial Sequence
  Description of Artificial Sequence: Synthetic peptide
  Seed: HDPSGYLAEADLSYT (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXT

SEQ ID NO: 328671 - protein, 16 aa, Artificial Sequence
  Description of Artificial Sequence: Synthetic peptide
  Seed: HDPSGYLAEADLSYTW (PMEL_HUMAN)
  Core: GYLAEADLS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HDPSXYLXEXDLXYTW

SEQ ID NO: 328672 - protein, 16 aa, Artificial Sequence
  Description of Artificial Sequence: Synthetic peptide
  Seed: HDPSGYLAEADLSYTW (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTW

SEQ ID NO: 328673 - protein, 19 aa, Artificial Sequence
  Description of Artificial Sequence: Synthetic peptide
  Seed: HDPSGYLAEADLSYTWDFG (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFG

SEQ ID NO: 328674 - protein, 20 aa, Artificial Sequence
  Description of Artificial Sequence: Synthetic peptide
  Seed: HDPSGYLAEADLSYTWDFGD (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFGD

SEQ ID NO: 328675 - protein, 21 aa, Artificial Sequence
  Description of Artificial Sequence: Synthetic peptide
  Seed: HDPSGYLAEADLSYTWDFGDS (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFGDS

SEQ ID NO: 328676 - protein, 21 aa, Artificial Sequence
  Description of Artificial Sequence: Synthetic peptide
  Seed: HDPSGYLAEADLSYTWDFGDS (PMEL_HUMAN)
  Core: LSYTWDFGD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGYLAEADXSYXWXFGXS

SEQ ID NO: 328677 - protein, 22 aa, Artificial Sequence
  Description of Artificial Sequence: Synthetic peptide
  Seed: HDPSGYLAEADLSYTWDFGDSS (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFGDSS

SEQ ID NO: 328678 - protein, 22 aa, Artificial Sequence
  Description of Artificial Sequence: Synthetic peptide
  Seed: HDPSGYLAEADLSYTWDFGDSS (PMEL_HUMAN)
  Core: LSYTWDFGD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGYLAEADXSYXWXFGXSS

SEQ ID NO: 328679 - protein, 23 aa, Artificial Sequence
  Description of Artificial Sequence: Synthetic peptide
  Seed: HDPSGYLAEADLSYTWDFGDSSG (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFGDSSG

SEQ ID NO: 328680 - protein, 23 aa, Artificial Sequence
  Description of Artificial Sequence: Synthetic peptide
  Seed: HDPSGYLAEADLSYTWDFGDSSG (PMEL_HUMAN)
  Core: LSYTWDFGD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGYLAEADXSYXWXFGXSSG

SEQ ID NO: 328681 - protein, 24 aa, Artificial Sequence
  Description of Artificial Sequence: Synthetic peptide
  Seed: HDPSGYLAEADLSYTWDFGDSSGT (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFGDSSGT

SEQ ID NO: 328682 - protein, 24 aa, Artificial Sequence
  Description of Artificial Sequence: Synthetic peptide
  Seed: HDPSGYLAEADLSYTWDFGDSSGT (PMEL_HUMAN)
  Core: LSYTWDFGD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGYLAEADXSYXWXFGXSSGT

SEQ ID NO: 328683 - protein, 25 aa, Artificial Sequence
  Description of Artificial Sequence: Synthetic peptide
  Seed: HDPSGYLAEADLSYTWDFGDSSGTL (PMEL_HUMAN)
  Core: YLAEADLSY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGXLAXAXLSXTWDFGDSSGTL

SEQ ID NO: 328684 - protein, 25 aa, Artificial Sequence
  Description of Artificial Sequence: Synthetic peptide
  Seed: HDPSGYLAEADLSYTWDFGDSSGTL (PMEL_HUMAN)
  Core: LSYTWDFGD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HDPSGYLAEADXSYXWXFGXSSGTL

SEQ ID NO: 328685 - protein, 13 aa, Artificial Sequence
  Description of Artificial Sequence: Synthetic peptide
  Seed: HFLRNQPLTFALQ (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQ

SEQ ID NO: 328686 - protein, 13 aa, Artificial Sequence
  Description of Artificial Sequence: Synthetic peptide
  Seed: HFLRNQPLTFALQ (PMEL_HUMAN)
  Core: LRNQPLTFA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HFXRNXPXTFXLQ

SEQ ID NO: 328687 - protein, 14 aa, Artificial Sequence
  Description of Artificial Sequence: Synthetic peptide
  Seed: HFLRNQPLTFALQL (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQL

SEQ ID NO: 328688 - protein, 14 aa, Artificial Sequence
  Description of Artificial Sequence: Synthetic peptide
  Seed: HFLRNQPLTFALQL (PMEL_HUMAN)
  Core: LRNQPLTFA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HFXRNXPXTFXLQL

SEQ ID NO: 328689 - protein, 14 aa, Artificial Sequence
  Description of Artificial Sequence: Synthetic peptide
  Seed: HFLRNQPLTFALQL (PMEL_HUMAN)
  Core: RNQPLTFAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HFLXNQXLXFAXQL

SEQ ID NO: 328690 - protein, 15 aa, Artificial Sequence
  Description of Artificial Sequence: Synthetic peptide
  Seed: HFLRNQPLTFALQLH (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLH

SEQ ID NO: 328691 - protein, 15 aa, Artificial Sequence
  Description of Artificial Sequence: Synthetic peptide
  Seed: HFLRNQPLTFALQLH (PMEL_HUMAN)
  Core: LRNQPLTFA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HFXRNXPXTFXLQLH

SEQ ID NO: 328692 - protein, 15 aa, Artificial Sequence
  Description of Artificial Sequence: Synthetic peptide
  Seed: HFLRNQPLTFALQLH (PMEL_HUMAN)
  Core: RNQPLTFAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HFLXNQXLXFAXQLH

SEQ ID NO: 328693 - protein, 15 aa, Artificial Sequence
  Description of Artificial Sequence: Synthetic peptide
  Seed: HFLRNQPLTFALQLH (PMEL_HUMAN)
  Core: NQPLTFALQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HFLRXQPXTXALXLH

SEQ ID NO: 328694 - protein, 15 aa, Artificial Sequence
  Description of Artificial Sequence: Synthetic peptide
  Seed: HFLRNQPLTFALQLH (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLX

SEQ ID NO: 328695 - protein, 16 aa, Artificial Sequence
  Description of Artificial Sequence: Synthetic peptide
  Seed: HFLRNQPLTFALQLHD (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHD

SEQ ID NO: 328696 - protein, 16 aa, Artificial Sequence
  Description of Artificial Sequence: Synthetic peptide
  Seed: HFLRNQPLTFALQLHD (PMEL_HUMAN)
  Core: LRNQPLTFA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HFXRNXPXTFXLQLHD

SEQ ID NO: 328697 - protein, 16 aa, Artificial Sequence
  Description of Artificial Sequence: Synthetic peptide
  Seed: HFLRNQPLTFALQLHD (PMEL_HUMAN)
  Core: RNQPLTFAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HFLXNQXLXFAXQLHD

SEQ ID NO: 328698 - protein, 16 aa, Artificial Sequence
  Description of Artificial Sequence: Synthetic peptide
  Seed: HFLRNQPLTFALQLHD (PMEL_HUMAN)
  Core: NQPLTFALQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HFLRXQPXTXALXLHD

SEQ ID NO: 328699 - protein, 16 aa, Artificial Sequence
  Description of Artificial Sequence: Synthetic peptide
  Seed: HFLRNQPLTFALQLHD (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXD

SEQ ID NO: 328700 - protein, 16 aa, Artificial Sequence
  Description of Artificial Sequence: Synthetic peptide
  Seed: HFLRNQPLTFALQLHD (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHX

SEQ ID NO: 328701 - protein, 17 aa, Artificial Sequence
  Description of Artificial Sequence: Synthetic peptide
  Seed: HFLRNQPLTFALQLHDP (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHDP

SEQ ID NO: 328702 - protein, 17 aa, Artificial Sequence
  Description of Artificial Sequence: Synthetic peptide
  Seed: HFLRNQPLTFALQLHDP (PMEL_HUMAN)
  Core: RNQPLTFAL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HFLXNQXLXFAXQLHDP

SEQ ID NO: 328703 - protein, 17 aa, Artificial Sequence
  Description of Artificial Sequence: Synthetic peptide
  Seed: HFLRNQPLTFALQLHDP (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDP

SEQ ID NO: 328704 - protein, 17 aa, Artificial Sequence
  Description of Artificial Sequence: Synthetic peptide
  Seed: HFLRNQPLTFALQLHDP (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXP

SEQ ID NO: 328705 - protein, 18 aa, Artificial Sequence
  Description of Artificial Sequence: Synthetic peptide
  Seed: HFLRNQPLTFALQLHDPS (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHDPS

SEQ ID NO: 328706 - protein, 18 aa, Artificial Sequence
  Description of Artificial Sequence: Synthetic peptide
  Seed: HFLRNQPLTFALQLHDPS (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPS

SEQ ID NO: 328707 - protein, 18 aa, Artificial Sequence
  Description of Artificial Sequence: Synthetic peptide
  Seed: HFLRNQPLTFALQLHDPS (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPS

SEQ ID NO: 328708 - protein, 19 aa, Artificial Sequence
  Description of Artificial Sequence: Synthetic peptide
  Seed: HFLRNQPLTFALQLHDPSG (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHDPSG

SEQ ID NO: 328709 - protein, 19 aa, Artificial Sequence
  Description of Artificial Sequence: Synthetic peptide
  Seed: HFLRNQPLTFALQLHDPSG (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSG

SEQ ID NO: 328710 - protein, 19 aa, Artificial Sequence
  Description of Artificial Sequence: Synthetic peptide
  Seed: HFLRNQPLTFALQLHDPSG (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXG

SEQ ID NO: 328711 - protein, 20 aa, Artificial Sequence
  Description of Artificial Sequence: Synthetic peptide
  Seed: HFLRNQPLTFALQLHDPSGY (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHDPSGY

SEQ ID NO: 328712 - protein, 20 aa, Artificial Sequence
  Description of Artificial Sequence: Synthetic peptide
  Seed: HFLRNQPLTFALQLHDPSGY (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPSGY

SEQ ID NO: 328713 - protein, 20 aa, Artificial Sequence
  Description of Artificial Sequence: Synthetic peptide
  Seed: HFLRNQPLTFALQLHDPSGY (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSGY

SEQ ID NO: 328714 - protein, 20 aa, Artificial Sequence
  Description of Artificial Sequence: Synthetic peptide
  Seed: HFLRNQPLTFALQLHDPSGY (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXGY

SEQ ID NO: 328715 - protein, 21 aa, Artificial Sequence
  Description of Artificial Sequence: Synthetic peptide
  Seed: HFLRNQPLTFALQLHDPSGYL (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHDPSGYL

SEQ ID NO: 328716 - protein, 21 aa, Artificial Sequence
  Description of Artificial Sequence: Synthetic peptide
  Seed: HFLRNQPLTFALQLHDPSGYL (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPSGYL

SEQ ID NO: 328717 - protein, 21 aa, Artificial Sequence
  Description of Artificial Sequence: Synthetic peptide
  Seed: HFLRNQPLTFALQLHDPSGYL (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSGYL

SEQ ID NO: 328718 - protein, 21 aa, Artificial Sequence
  Description of Artificial Sequence: Synthetic peptide
  Seed: HFLRNQPLTFALQLHDPSGYL (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXGYL

SEQ ID NO: 328719 - protein, 22 aa, Artificial Sequence
  Description of Artificial Sequence: Synthetic peptide
  Seed: HFLRNQPLTFALQLHDPSGYLA (PMEL_HUMAN)
  Core: FLRNQPLTF
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXQXLTXALQLHDPSGYLA

SEQ ID NO: 328720 - protein, 22 aa, Artificial Sequence
  Description of Artificial Sequence: Synthetic peptide
  Seed: HFLRNQPLTFALQLHDPSGYLA (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPSGYLA

SEQ ID NO: 328721 - protein, 22 aa, Artificial Sequence
  Description of Artificial Sequence: Synthetic peptide
  Seed: HFLRNQPLTFALQLHDPSGYLA (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSGYLA

SEQ ID NO: 328722 - protein, 22 aa, Artificial Sequence
  Description of Artificial Sequence: Synthetic peptide
  Seed: HFLRNQPLTFALQLHDPSGYLA (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXGYLA

SEQ ID NO: 328723 - protein, 22 aa, Artificial Sequence
  Description of Artificial Sequence: Synthetic peptide
  Seed: HFLRNQPLTFALQLHDPSGYLA (PMEL_HUMAN)
  Core: LQLHDPSGY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTFAXQLXDXSGXLA

SEQ ID NO: 328724 - protein, 23 aa, Artificial Sequence
  Description of Artificial Sequence: Synthetic peptide
  Seed: HFLRNQPLTFALQLHDPSGYLAE (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPSGYLAE

SEQ ID NO: 328725 - protein, 23 aa, Artificial Sequence
  Description of Artificial Sequence: Synthetic peptide
  Seed: HFLRNQPLTFALQLHDPSGYLAE (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSGYLAE

SEQ ID NO: 328726 - protein, 23 aa, Artificial Sequence
  Description of Artificial Sequence: Synthetic peptide
  Seed: HFLRNQPLTFALQLHDPSGYLAE (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXGYLAE

SEQ ID NO: 328727 - protein, 23 aa, Artificial Sequence
  Description of Artificial Sequence: Synthetic peptide
  Seed: HFLRNQPLTFALQLHDPSGYLAE (PMEL_HUMAN)
  Core: LQLHDPSGY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTFAXQLXDXSGXLAE

SEQ ID NO: 328728 - protein, 24 aa, Artificial Sequence
  Description of Artificial Sequence: Synthetic peptide
  Seed: HFLRNQPLTFALQLHDPSGYLAEA (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPSGYLAEA

SEQ ID NO: 328729 - protein, 24 aa, Artificial Sequence
  Description of Artificial Sequence: Synthetic peptide
  Seed: HFLRNQPLTFALQLHDPSGYLAEA (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSGYLAEA

SEQ ID NO: 328730 - protein, 24 aa, Artificial Sequence
  Description of Artificial Sequence: Synthetic peptide
  Seed: HFLRNQPLTFALQLHDPSGYLAEA (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXGYLAEA

SEQ ID NO: 328731 - protein, 24 aa, Artificial Sequence
  Description of Artificial Sequence: Synthetic peptide
  Seed: HFLRNQPLTFALQLHDPSGYLAEA (PMEL_HUMAN)
  Core: LQLHDPSGY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTFAXQLXDXSGXLAEA

SEQ ID NO: 328732 - protein, 25 aa, Artificial Sequence
  Description of Artificial Sequence: Synthetic peptide
  Seed: HFLRNQPLTFALQLHDPSGYLAEAD (PMEL_HUMAN)
  Core: PLTFALQLH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQXLTXAXQLXDPSGYLAEAD

SEQ ID NO: 328733 - protein, 25 aa, Artificial Sequence
  Description of Artificial Sequence: Synthetic peptide
  Seed: HFLRNQPLTFALQLHDPSGYLAEAD (PMEL_HUMAN)
  Core: LTFALQLHD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPXTFXLXLHXPSGYLAEAD

SEQ ID NO: 328734 - protein, 25 aa, Artificial Sequence
  Description of Artificial Sequence: Synthetic peptide
  Seed: HFLRNQPLTFALQLHDPSGYLAEAD (PMEL_HUMAN)
  Core: FALQLHDPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTXALXLXDPXGYLAEAD

SEQ ID NO: 328735 - protein, 25 aa, Artificial Sequence
  Description of Artificial Sequence: Synthetic peptide
  Seed: HFLRNQPLTFALQLHDPSGYLAEAD (PMEL_HUMAN)
  Core: LQLHDPSGY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTFAXQLXDXSGXLAEAD

SEQ ID NO: 328736 - protein, 25 aa, Artificial Sequence
  Description of Artificial Sequence: Synthetic peptide
  Seed: HFLRNQPLTFALQLHDPSGYLAEAD (PMEL_HUMAN)
  Core: LHDPSGYLA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HFLRNQPLTFALQXHDXSXYLXEAD

SEQ ID NO: 328737 - protein, 13 aa, Artificial Sequence
  Description of Artificial Sequence: Synthetic peptide
  Seed: HLAVIGALLAVGA (PMEL_HUMAN)
  Core: LAVIGALLA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXAVXGXLLXVGA

SEQ ID NO: 328738 - protein, 13 aa, Artificial Sequence
  Description of Artificial Sequence: Synthetic peptide
  Seed: HLAVIGALLAVGA (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXA

SEQ ID NO: 328739 - protein, 13 aa, Artificial Sequence
  Description of Artificial Sequence: Synthetic peptide
  Seed: HLAVIGALLAVGA (PMEL_HUMAN)
  Core: IGALLAVGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HLAVXGAXLXVGX

SEQ ID NO: 328740 - protein, 14 aa, Artificial Sequence
  Description of Artificial Sequence: Synthetic peptide
  Seed: HLAVIGALLAVGAT (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXAT

SEQ ID NO: 328741 - protein, 14 aa, Artificial Sequence
  Description of Artificial Sequence: Synthetic peptide
  Seed: HLAVIGALLAVGAT (PMEL_HUMAN)
  Core: IGALLAVGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HLAVXGAXLXVGXT

SEQ ID NO: 328742 - protein, 15 aa, Artificial Sequence
  Description of Artificial Sequence: Synthetic peptide
  Seed: HLAVIGALLAVGATK (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXATK

SEQ ID NO: 328743 - protein, 15 aa, Artificial Sequence
  Description of Artificial Sequence: Synthetic peptide
  Seed: HLAVIGALLAVGATK (PMEL_HUMAN)
  Core: IGALLAVGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HLAVXGAXLXVGXTK

SEQ ID NO: 328744 - protein, 16 aa, Artificial Sequence
  Description of Artificial Sequence: Synthetic peptide
  Seed: HLAVIGALLAVGATKV (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXATKV

SEQ ID NO: 328745 - protein, 16 aa, Artificial Sequence
  Description of Artificial Sequence: Synthetic peptide
  Seed: HLAVIGALLAVGATKV (PMEL_HUMAN)
  Core: IGALLAVGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HLAVXGAXLXVGXTKV

SEQ ID NO: 328746 - protein, 16 aa, Artificial Sequence
  Description of Artificial Sequence: Synthetic peptide
  Seed: HLAVIGALLAVGATKV (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKX

SEQ ID NO: 328747 - protein, 17 aa, Artificial Sequence
  Description of Artificial Sequence: Synthetic peptide
  Seed: HLAVIGALLAVGATKVP (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXATKVP

SEQ ID NO: 328748 - protein, 17 aa, Artificial Sequence
  Description of Artificial Sequence: Synthetic peptide
  Seed: HLAVIGALLAVGATKVP (PMEL_HUMAN)
  Core: IGALLAVGA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HLAVXGAXLXVGXTKVP

SEQ ID NO: 328749 - protein, 17 aa, Artificial Sequence
  Description of Artificial Sequence: Synthetic peptide
  Seed: HLAVIGALLAVGATKVP (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXP

SEQ ID NO: 328750 - protein, 18 aa, Artificial Sequence
  Description of Artificial Sequence: Synthetic peptide
  Seed: HLAVIGALLAVGATKVPR (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXATKVPR

SEQ ID NO: 328751 - protein, 18 aa, Artificial Sequence
  Description of Artificial Sequence: Synthetic peptide
  Seed: HLAVIGALLAVGATKVPR (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPR

SEQ ID NO: 328752 - protein, 19 aa, Artificial Sequence
  Description of Artificial Sequence: Synthetic peptide
  Seed: HLAVIGALLAVGATKVPRN (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXATKVPRN

SEQ ID NO: 328753 - protein, 19 aa, Artificial Sequence
  Description of Artificial Sequence: Synthetic peptide
  Seed: HLAVIGALLAVGATKVPRN (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRN

SEQ ID NO: 328754 - protein, 20 aa, Artificial Sequence
  Description of Artificial Sequence: Synthetic peptide
  Seed: HLAVIGALLAVGATKVPRNQ (PMEL_HUMAN)
  Core: VIGALLAVG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HLAXIGXLXAVXATKVPRNQ

SEQ ID NO: 328755 - protein, 20 aa, Artificial Sequence
  Description of Artificial Sequence: Synthetic peptide
  Seed: HLAVIGALLAVGATKVPRNQ (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRNQ

SEQ ID NO: 328756 - protein, 20 aa, Artificial Sequence
  Description of Artificial Sequence: Synthetic peptide
  Seed: HLAVIGALLAVGATKVPRNQ (PMEL_HUMAN)
  Core: VGATKVPRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLAXGAXKXPRXQ

SEQ ID NO: 328757 - protein, 21 aa, Artificial Sequence
  Description of Artificial Sequence: Synthetic peptide
  Seed: HLAVIGALLAVGATKVPRNQD (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRNQD

SEQ ID NO: 328758 - protein, 21 aa, Artificial Sequence
  Description of Artificial Sequence: Synthetic peptide
  Seed: HLAVIGALLAVGATKVPRNQD (PMEL_HUMAN)
  Core: VGATKVPRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLAXGAXKXPRXQD

SEQ ID NO: 328759 - protein, 22 aa, Artificial Sequence
  Description of Artificial Sequence: Synthetic peptide
  Seed: HLAVIGALLAVGATKVPRNQDW (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRNQDW

SEQ ID NO: 328760 - protein, 22 aa, Artificial Sequence
  Description of Artificial Sequence: Synthetic peptide
  Seed: HLAVIGALLAVGATKVPRNQDW (PMEL_HUMAN)
  Core: VGATKVPRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLAXGAXKXPRXQDW

SEQ ID NO: 328761 - protein, 23 aa, Artificial Sequence
  Description of Artificial Sequence: Synthetic peptide
  Seed: HLAVIGALLAVGATKVPRNQDWL (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRNQDWL

SEQ ID NO: 328762 - protein, 23 aa, Artificial Sequence
  Description of Artificial Sequence: Synthetic peptide
  Seed: HLAVIGALLAVGATKVPRNQDWL (PMEL_HUMAN)
  Core: AVGATKVPR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLXVGXTXVPXNQDWL

SEQ ID NO: 328763 - protein, 23 aa, Artificial Sequence
  Description of Artificial Sequence: Synthetic peptide
  Seed: HLAVIGALLAVGATKVPRNQDWL (PMEL_HUMAN)
  Core: VGATKVPRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLAXGAXKXPRXQDWL

SEQ ID NO: 328764 - protein, 24 aa, Artificial Sequence
  Description of Artificial Sequence: Synthetic peptide
  Seed: HLAVIGALLAVGATKVPRNQDWLG (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRNQDWLG

SEQ ID NO: 328765 - protein, 24 aa, Artificial Sequence
  Description of Artificial Sequence: Synthetic peptide
  Seed: HLAVIGALLAVGATKVPRNQDWLG (PMEL_HUMAN)
  Core: AVGATKVPR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLXVGXTXVPXNQDWLG

SEQ ID NO: 328766 - protein, 24 aa, Artificial Sequence
  Description of Artificial Sequence: Synthetic peptide
  Seed: HLAVIGALLAVGATKVPRNQDWLG (PMEL_HUMAN)
  Core: VGATKVPRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLAXGAXKXPRXQDWLG

SEQ ID NO: 328767 - protein, 25 aa, Artificial Sequence
  Description of Artificial Sequence: Synthetic peptide
  Seed: HLAVIGALLAVGATKVPRNQDWLGV (PMEL_HUMAN)
  Core: LLAVGATKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGAXLAXGXTKXPRNQDWLGV

SEQ ID NO: 328768 - protein, 25 aa, Artificial Sequence
  Description of Artificial Sequence: Synthetic peptide
  Seed: HLAVIGALLAVGATKVPRNQDWLGV (PMEL_HUMAN)
  Core: AVGATKVPR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLXVGXTXVPXNQDWLGV

SEQ ID NO: 328769 - protein, 25 aa, Artificial Sequence
  Description of Artificial Sequence: Synthetic peptide
  Seed: HLAVIGALLAVGATKVPRNQDWLGV (PMEL_HUMAN)
  Core: VGATKVPRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HLAVIGALLAXGAXKXPRXQDWLGV

SEQ ID NO: 328770 - protein, 14 aa, Artificial Sequence
  Description of Artificial Sequence: Synthetic peptide
  Seed: HQILKGGSGTYCLN (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLN

SEQ ID NO: 328771 - protein, 15 aa, Artificial Sequence
  Description of Artificial Sequence: Synthetic peptide
  Seed: HQILKGGSGTYCLNV (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNV

SEQ ID NO: 328772 - protein, 16 aa, Artificial Sequence
  Description of Artificial Sequence: Synthetic peptide
  Seed: HQILKGGSGTYCLNVS (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNVS

SEQ ID NO: 328773 - protein, 17 aa, Artificial Sequence
  Description of Artificial Sequence: Synthetic peptide
  Seed: HQILKGGSGTYCLNVSL (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNVSL

SEQ ID NO: 328774 - protein, 19 aa, Artificial Sequence
  Description of Artificial Sequence: Synthetic peptide
  Seed: HQILKGGSGTYCLNVSLAD (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNVSLAD

SEQ ID NO: 328775 - protein, 19 aa, Artificial Sequence
  Description of Artificial Sequence: Synthetic peptide
  Seed: HQILKGGSGTYCLNVSLAD (PMEL_HUMAN)
  Core: SGTYCLNVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGXGTXCXNVXLAD

SEQ ID NO: 328776 - protein, 20 aa, Artificial Sequence
  Description of Artificial Sequence: Synthetic peptide
  Seed: HQILKGGSGTYCLNVSLADT (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNVSLADT

SEQ ID NO: 328777 - protein, 20 aa, Artificial Sequence
  Description of Artificial Sequence: Synthetic peptide
  Seed: HQILKGGSGTYCLNVSLADT (PMEL_HUMAN)
  Core: SGTYCLNVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGXGTXCXNVXLADT

SEQ ID NO: 328778 - protein, 20 aa, Artificial Sequence
  Description of Artificial Sequence: Synthetic peptide
  Seed: HQILKGGSGTYCLNVSLADT (PMEL_HUMAN)
  Core: TYCLNVSLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGXYCXNXSLXDT

SEQ ID NO: 328779 - protein, 20 aa, Artificial Sequence
  Description of Artificial Sequence: Synthetic peptide
  Seed: HQILKGGSGTYCLNVSLADT (PMEL_HUMAN)
  Core: YCLNVSLAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTXCLXVXLAXT

SEQ ID NO: 328780 - protein, 21 aa, Artificial Sequence
  Description of Artificial Sequence: Synthetic peptide
  Seed: HQILKGGSGTYCLNVSLADTN (PMEL_HUMAN)
  Core: SGTYCLNVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGXGTXCXNVXLADTN

SEQ ID NO: 328781 - protein, 21 aa, Artificial Sequence
  Description of Artificial Sequence: Synthetic peptide
  Seed: HQILKGGSGTYCLNVSLADTN (PMEL_HUMAN)
  Core: YCLNVSLAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTXCLXVXLAXTN

SEQ ID NO: 328782 - protein, 22 aa, Artificial Sequence
  Description of Artificial Sequence: Synthetic peptide
  Seed: HQILKGGSGTYCLNVSLADTNS (PMEL_HUMAN)
  Core: YCLNVSLAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTXCLXVXLAXTNS

SEQ ID NO: 328783 - protein, 23 aa, Artificial Sequence
  Description of Artificial Sequence: Synthetic peptide
  Seed: HQILKGGSGTYCLNVSLADTNSL (PMEL_HUMAN)
  Core: YCLNVSLAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTXCLXVXLAXTNSL

SEQ ID NO: 328784 - protein, 24 aa, Artificial Sequence
  Description of Artificial Sequence: Synthetic peptide
  Seed: HQILKGGSGTYCLNVSLADTNSLA (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNVSLADTNSLA

SEQ ID NO: 328785 - protein, 24 aa, Artificial Sequence
  Description of Artificial Sequence: Synthetic peptide
  Seed: HQILKGGSGTYCLNVSLADTNSLA (PMEL_HUMAN)
  Core: TYCLNVSLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGXYCXNXSLXDTNSLA

SEQ ID NO: 328786 - protein, 24 aa, Artificial Sequence
  Description of Artificial Sequence: Synthetic peptide
  Seed: HQILKGGSGTYCLNVSLADTNSLA (PMEL_HUMAN)
  Core: YCLNVSLAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTXCLXVXLAXTNSLA

SEQ ID NO: 328787 - protein, 25 aa, Artificial Sequence
  Description of Artificial Sequence: Synthetic peptide
  Seed: HQILKGGSGTYCLNVSLADTNSLAV (PMEL_HUMAN)
  Core: LKGGSGTYC
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HQIXKGXSXTYXLNVSLADTNSLAV

SEQ ID NO: 328788 - protein, 25 aa, Artificial Sequence
  Description of Artificial Sequence: Synthetic peptide
  Seed: HQILKGGSGTYCLNVSLADTNSLAV (PMEL_HUMAN)
  Core: TYCLNVSLA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGXYCXNXSLXDTNSLAV

SEQ ID NO: 328789 - protein, 25 aa, Artificial Sequence
  Description of Artificial Sequence: Synthetic peptide
  Seed: HQILKGGSGTYCLNVSLADTNSLAV (PMEL_HUMAN)
  Core: YCLNVSLAD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTXCLXVXLAXTNSLAV

SEQ ID NO: 328790 - protein, 25 aa, Artificial Sequence
  Description of Artificial Sequence: Synthetic peptide
  Seed: HQILKGGSGTYCLNVSLADTNSLAV (PMEL_HUMAN)
  Core: VSLADTNSL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTYCLNXSLXDXNSXAV

SEQ ID NO: 328791 - protein, 25 aa, Artificial Sequence
  Description of Artificial Sequence: Synthetic peptide
  Seed: HQILKGGSGTYCLNVSLADTNSLAV (PMEL_HUMAN)
  Core: LADTNSLAV
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
HQILKGGSGTYCLNVSXADXNXLAX

SEQ ID NO: 328792 - protein, 19 aa, Artificial Sequence
  Description of Artificial Sequence: Synthetic peptide
  Seed: HRPTAEAPNTTAGQVPTTE (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXE

SEQ ID NO: 328793 - protein, 20 aa, Artificial Sequence
  Description of Artificial Sequence: Synthetic peptide
  Seed: HRPTAEAPNTTAGQVPTTEV (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXEV

SEQ ID NO: 328794 - protein, 21 aa, Artificial Sequence
  Description of Artificial Sequence: Synthetic peptide
  Seed: HRPTAEAPNTTAGQVPTTEVV (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXEVV

SEQ ID NO: 328795 - protein, 22 aa, Artificial Sequence
  Description of Artificial Sequence: Synthetic peptide
  Seed: HRPTAEAPNTTAGQVPTTEVVG (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXEVVG

SEQ ID NO: 328796 - protein, 23 aa, Artificial Sequence
  Description of Artificial Sequence: Synthetic peptide
  Seed: HRPTAEAPNTTAGQVPTTEVVGT (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXEVVGT

SEQ ID NO: 328797 - protein, 24 aa, Artificial Sequence
  Description of Artificial Sequence: Synthetic peptide
  Seed: HRPTAEAPNTTAGQVPTTEVVGTT (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXEVVGTT

SEQ ID NO: 328798 - protein, 25 aa, Artificial Sequence
  Description of Artificial Sequence: Synthetic peptide
  Seed: HRPTAEAPNTTAGQVPTTEVVGTTP (PMEL_HUMAN)
  Core: TTAGQVPTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HRPTAEAPNXTAXQXPTXEVVGTTP

SEQ ID NO: 328799 - protein, 14 aa, Artificial Sequence
  Description of Artificial Sequence: Synthetic peptide
  Seed: HRRGSRSYVPLAHS (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHS

SEQ ID NO: 328800 - protein, 14 aa, Artificial Sequence
  Description of Artificial Sequence: Synthetic peptide
  Seed: HRRGSRSYVPLAHS (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXS

SEQ ID NO: 328801 - protein, 14 aa, Artificial Sequence
  Description of Artificial Sequence: Synthetic peptide
  Seed: HRRGSRSYVPLAHS (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHX

SEQ ID NO: 328802 - protein, 15 aa, Artificial Sequence
  Description of Artificial Sequence: Synthetic peptide
  Seed: HRRGSRSYVPLAHSS (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHSS

SEQ ID NO: 328803 - protein, 15 aa, Artificial Sequence
  Description of Artificial Sequence: Synthetic peptide
  Seed: HRRGSRSYVPLAHSS (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSS

SEQ ID NO: 328804 - protein, 15 aa, Artificial Sequence
  Description of Artificial Sequence: Synthetic peptide
  Seed: HRRGSRSYVPLAHSS (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXS

SEQ ID NO: 328805 - protein, 16 aa, Artificial Sequence
  Description of Artificial Sequence: Synthetic peptide
  Seed: HRRGSRSYVPLAHSSS (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHSSS

SEQ ID NO: 328806 - protein, 16 aa, Artificial Sequence
  Description of Artificial Sequence: Synthetic peptide
  Seed: HRRGSRSYVPLAHSSS (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSS

SEQ ID NO: 328807 - protein, 16 aa, Artificial Sequence
  Description of Artificial Sequence: Synthetic peptide
  Seed: HRRGSRSYVPLAHSSS (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSS

SEQ ID NO: 328808 - protein, 16 aa, Artificial Sequence
  Description of Artificial Sequence: Synthetic peptide
  Seed: HRRGSRSYVPLAHSSS (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSX

SEQ ID NO: 328809 - protein, 17 aa, Artificial Sequence
  Description of Artificial Sequence: Synthetic peptide
  Seed: HRRGSRSYVPLAHSSSA (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHSSSA

SEQ ID NO: 328810 - protein, 17 aa, Artificial Sequence
  Description of Artificial Sequence: Synthetic peptide
  Seed: HRRGSRSYVPLAHSSSA (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSA

SEQ ID NO: 328811 - protein, 17 aa, Artificial Sequence
  Description of Artificial Sequence: Synthetic peptide
  Seed: HRRGSRSYVPLAHSSSA (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSA

SEQ ID NO: 328812 - protein, 17 aa, Artificial Sequence
  Description of Artificial Sequence: Synthetic peptide
  Seed: HRRGSRSYVPLAHSSSA (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXA

SEQ ID NO: 328813 - protein, 18 aa, Artificial Sequence
  Description of Artificial Sequence: Synthetic peptide
  Seed: HRRGSRSYVPLAHSSSAF (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHSSSAF

SEQ ID NO: 328814 - protein, 18 aa, Artificial Sequence
  Description of Artificial Sequence: Synthetic peptide
  Seed: HRRGSRSYVPLAHSSSAF (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAF

SEQ ID NO: 328815 - protein, 18 aa, Artificial Sequence
  Description of Artificial Sequence: Synthetic peptide
  Seed: HRRGSRSYVPLAHSSSAF (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAF

SEQ ID NO: 328816 - protein, 19 aa, Artificial Sequence
  Description of Artificial Sequence: Synthetic peptide
  Seed: HRRGSRSYVPLAHSSSAFT (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHSSSAFT

SEQ ID NO: 328817 - protein, 19 aa, Artificial Sequence
  Description of Artificial Sequence: Synthetic peptide
  Seed: HRRGSRSYVPLAHSSSAFT (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFT

SEQ ID NO: 328818 - protein, 19 aa, Artificial Sequence
  Description of Artificial Sequence: Synthetic peptide
  Seed: HRRGSRSYVPLAHSSSAFT (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFT

SEQ ID NO: 328819 - protein, 19 aa, Artificial Sequence
  Description of Artificial Sequence: Synthetic peptide
  Seed: HRRGSRSYVPLAHSSSAFT (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFT

SEQ ID NO: 328820 - protein, 19 aa, Artificial Sequence
  Description of Artificial Sequence: Synthetic peptide
  Seed: HRRGSRSYVPLAHSSSAFT (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFX

SEQ ID NO: 328821 - protein, 20 aa, Artificial Sequence
  Description of Artificial Sequence: Synthetic peptide
  Seed: HRRGSRSYVPLAHSSSAFTI (PMEL_HUMAN)
  Core: GSRSYVPLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HRRXSRXYXPLXHSSSAFTI

SEQ ID NO: 328822 - protein, 20 aa, Artificial Sequence
  Description of Artificial Sequence: Synthetic peptide
  Seed: HRRGSRSYVPLAHSSSAFTI (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFTI

SEQ ID NO: 328823 - protein, 20 aa, Artificial Sequence
  Description of Artificial Sequence: Synthetic peptide
  Seed: HRRGSRSYVPLAHSSSAFTI (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFTI

SEQ ID NO: 328824 - protein, 20 aa, Artificial Sequence
  Description of Artificial Sequence: Synthetic peptide
  Seed: HRRGSRSYVPLAHSSSAFTI (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFTI

SEQ ID NO: 328825 - protein, 20 aa, Artificial Sequence
  Description of Artificial Sequence: Synthetic peptide
  Seed: HRRGSRSYVPLAHSSSAFTI (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFXI

SEQ ID NO: 328826 - protein, 21 aa, Artificial Sequence
  Description of Artificial Sequence: Synthetic peptide
  Seed: HRRGSRSYVPLAHSSSAFTIT (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFTIT

SEQ ID NO: 328827 - protein, 21 aa, Artificial Sequence
  Description of Artificial Sequence: Synthetic peptide
  Seed: HRRGSRSYVPLAHSSSAFTIT (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFTIT

SEQ ID NO: 328828 - protein, 21 aa, Artificial Sequence
  Description of Artificial Sequence: Synthetic peptide
  Seed: HRRGSRSYVPLAHSSSAFTIT (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFTIT

SEQ ID NO: 328829 - protein, 21 aa, Artificial Sequence
  Description of Artificial Sequence: Synthetic peptide
  Seed: HRRGSRSYVPLAHSSSAFTIT (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFXIT

SEQ ID NO: 328830 - protein, 21 aa, Artificial Sequence
  Description of Artificial Sequence: Synthetic peptide
  Seed: HRRGSRSYVPLAHSSSAFTIT (PMEL_HUMAN)
  Core: AHSSSAFTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPLXHSXSXFTXT

SEQ ID NO: 328831 - protein, 22 aa, Artificial Sequence
  Description of Artificial Sequence: Synthetic peptide
  Seed: HRRGSRSYVPLAHSSSAFTITD (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFTITD

SEQ ID NO: 328832 - protein, 22 aa, Artificial Sequence
  Description of Artificial Sequence: Synthetic peptide
  Seed: HRRGSRSYVPLAHSSSAFTITD (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFTITD

SEQ ID NO: 328833 - protein, 22 aa, Artificial Sequence
  Description of Artificial Sequence: Synthetic peptide
  Seed: HRRGSRSYVPLAHSSSAFTITD (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFTITD

SEQ ID NO: 328834 - protein, 22 aa, Artificial Sequence
  Description of Artificial Sequence: Synthetic peptide
  Seed: HRRGSRSYVPLAHSSSAFTITD (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFXITD

SEQ ID NO: 328835 - protein, 22 aa, Artificial Sequence
  Description of Artificial Sequence: Synthetic peptide
  Seed: HRRGSRSYVPLAHSSSAFTITD (PMEL_HUMAN)
  Core: AHSSSAFTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPLXHSXSXFTXTD

SEQ ID NO: 328836 - protein, 23 aa, Artificial Sequence
  Description of Artificial Sequence: Synthetic peptide
  Seed: HRRGSRSYVPLAHSSSAFTITDQ (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFTITDQ

SEQ ID NO: 328837 - protein, 23 aa, Artificial Sequence
  Description of Artificial Sequence: Synthetic peptide
  Seed: HRRGSRSYVPLAHSSSAFTITDQ (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFTITDQ

SEQ ID NO: 328838 - protein, 23 aa, Artificial Sequence
  Description of Artificial Sequence: Synthetic peptide
  Seed: HRRGSRSYVPLAHSSSAFTITDQ (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFTITDQ

SEQ ID NO: 328839 - protein, 23 aa, Artificial Sequence
  Description of Artificial Sequence: Synthetic peptide
  Seed: HRRGSRSYVPLAHSSSAFTITDQ (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFXITDQ

SEQ ID NO: 328840 - protein, 23 aa, Artificial Sequence
  Description of Artificial Sequence: Synthetic peptide
  Seed: HRRGSRSYVPLAHSSSAFTITDQ (PMEL_HUMAN)
  Core: AHSSSAFTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPLXHSXSXFTXTDQ

SEQ ID NO: 328841 - protein, 24 aa, Artificial Sequence
  Description of Artificial Sequence: Synthetic peptide
  Seed: HRRGSRSYVPLAHSSSAFTITDQV (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFTITDQV

SEQ ID NO: 328842 - protein, 24 aa, Artificial Sequence
  Description of Artificial Sequence: Synthetic peptide
  Seed: HRRGSRSYVPLAHSSSAFTITDQV (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFTITDQV

SEQ ID NO: 328843 - protein, 24 aa, Artificial Sequence
  Description of Artificial Sequence: Synthetic peptide
  Seed: HRRGSRSYVPLAHSSSAFTITDQV (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFTITDQV

SEQ ID NO: 328844 - protein, 24 aa, Artificial Sequence
  Description of Artificial Sequence: Synthetic peptide
  Seed: HRRGSRSYVPLAHSSSAFTITDQV (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFXITDQV

SEQ ID NO: 328845 - protein, 24 aa, Artificial Sequence
  Description of Artificial Sequence: Synthetic peptide
  Seed: HRRGSRSYVPLAHSSSAFTITDQV (PMEL_HUMAN)
  Core: AHSSSAFTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPLXHSXSXFTXTDQV

SEQ ID NO: 328846 - protein, 25 aa, Artificial Sequence
  Description of Artificial Sequence: Synthetic peptide
  Seed: HRRGSRSYVPLAHSSSAFTITDQVP (PMEL_HUMAN)
  Core: SRSYVPLAH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HRRGXRSXVXLAXSSSAFTITDQVP

SEQ ID NO: 328847 - protein, 25 aa, Artificial Sequence
  Description of Artificial Sequence: Synthetic peptide
  Seed: HRRGSRSYVPLAHSSSAFTITDQVP (PMEL_HUMAN)
  Core: RSYVPLAHS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSXSYXPXAHXSSAFTITDQVP

SEQ ID NO: 328848 - protein, 25 aa, Artificial Sequence
  Description of Artificial Sequence: Synthetic peptide
  Seed: HRRGSRSYVPLAHSSSAFTITDQVP (PMEL_HUMAN)
  Core: YVPLAHSSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSXVPXAXSSXAFTITDQVP

SEQ ID NO: 328849 - protein, 25 aa, Artificial Sequence
  Description of Artificial Sequence: Synthetic peptide
  Seed: HRRGSRSYVPLAHSSSAFTITDQVP (PMEL_HUMAN)
  Core: LAHSSSAFT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPXAHXSXAFXITDQVP

SEQ ID NO: 328850 - protein, 25 aa, Artificial Sequence
  Description of Artificial Sequence: Synthetic peptide
  Seed: HRRGSRSYVPLAHSSSAFTITDQVP (PMEL_HUMAN)
  Core: AHSSSAFTI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPLXHSXSXFTXTDQVP

SEQ ID NO: 328851 - protein, 25 aa, Artificial Sequence
  Description of Artificial Sequence: Synthetic peptide
  Seed: HRRGSRSYVPLAHSSSAFTITDQVP (PMEL_HUMAN)
  Core: SSSAFTITD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HRRGSRSYVPLAHXSSXFXITXQVP

SEQ ID NO: 328852 - protein, 14 aa, Artificial Sequence
  Description of Artificial Sequence: Synthetic peptide
  Seed: HSSSAFTITDQVPF (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPF

SEQ ID NO: 328853 - protein, 15 aa, Artificial Sequence
  Description of Artificial Sequence: Synthetic peptide
  Seed: HSSSAFTITDQVPFS (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFS

SEQ ID NO: 328854 - protein, 15 aa, Artificial Sequence
  Description of Artificial Sequence: Synthetic peptide
  Seed: HSSSAFTITDQVPFS (PMEL_HUMAN)
  Core: AFTITDQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HSSSXFTXTXQVXFS

SEQ ID NO: 328855 - protein, 15 aa, Artificial Sequence
  Description of Artificial Sequence: Synthetic peptide
  Seed: HSSSAFTITDQVPFS (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXS

SEQ ID NO: 328856 - protein, 16 aa, Artificial Sequence
  Description of Artificial Sequence: Synthetic peptide
  Seed: HSSSAFTITDQVPFSV (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSV

SEQ ID NO: 328857 - protein, 16 aa, Artificial Sequence
  Description of Artificial Sequence: Synthetic peptide
  Seed: HSSSAFTITDQVPFSV (PMEL_HUMAN)
  Core: AFTITDQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HSSSXFTXTXQVXFSV

SEQ ID NO: 328858 - protein, 16 aa, Artificial Sequence
  Description of Artificial Sequence: Synthetic peptide
  Seed: HSSSAFTITDQVPFSV (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSV

SEQ ID NO: 328859 - protein, 17 aa, Artificial Sequence
  Description of Artificial Sequence: Synthetic peptide
  Seed: HSSSAFTITDQVPFSVS (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVS

SEQ ID NO: 328860 - protein, 17 aa, Artificial Sequence
  Description of Artificial Sequence: Synthetic peptide
  Seed: HSSSAFTITDQVPFSVS (PMEL_HUMAN)
  Core: AFTITDQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HSSSXFTXTXQVXFSVS

SEQ ID NO: 328861 - protein, 17 aa, Artificial Sequence
  Description of Artificial Sequence: Synthetic peptide
  Seed: HSSSAFTITDQVPFSVS (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVS

SEQ ID NO: 328862 - protein, 18 aa, Artificial Sequence
  Description of Artificial Sequence: Synthetic peptide
  Seed: HSSSAFTITDQVPFSVSV (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSV

SEQ ID NO: 328863 - protein, 18 aa, Artificial Sequence
  Description of Artificial Sequence: Synthetic peptide
  Seed: HSSSAFTITDQVPFSVSV (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSV

SEQ ID NO: 328864 - protein, 19 aa, Artificial Sequence
  Description of Artificial Sequence: Synthetic peptide
  Seed: HSSSAFTITDQVPFSVSVS (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVS

SEQ ID NO: 328865 - protein, 19 aa, Artificial Sequence
  Description of Artificial Sequence: Synthetic peptide
  Seed: HSSSAFTITDQVPFSVSVS (PMEL_HUMAN)
  Core: AFTITDQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HSSSXFTXTXQVXFSVSVS

SEQ ID NO: 328866 - protein, 19 aa, Artificial Sequence
  Description of Artificial Sequence: Synthetic peptide
  Seed: HSSSAFTITDQVPFSVSVS (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVS

SEQ ID NO: 328867 - protein, 19 aa, Artificial Sequence
  Description of Artificial Sequence: Synthetic peptide
  Seed: HSSSAFTITDQVPFSVSVS (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVS

SEQ ID NO: 328868 - protein, 20 aa, Artificial Sequence
  Description of Artificial Sequence: Synthetic peptide
  Seed: HSSSAFTITDQVPFSVSVSQ (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVSQ

SEQ ID NO: 328869 - protein, 20 aa, Artificial Sequence
  Description of Artificial Sequence: Synthetic peptide
  Seed: HSSSAFTITDQVPFSVSVSQ (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVSQ

SEQ ID NO: 328870 - protein, 20 aa, Artificial Sequence
  Description of Artificial Sequence: Synthetic peptide
  Seed: HSSSAFTITDQVPFSVSVSQ (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVSQ

SEQ ID NO: 328871 - protein, 20 aa, Artificial Sequence
  Description of Artificial Sequence: Synthetic peptide
  Seed: HSSSAFTITDQVPFSVSVSQ (PMEL_HUMAN)
  Core: QVPFSVSVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDXVPXSXSVXQ

SEQ ID NO: 328872 - protein, 21 aa, Artificial Sequence
  Description of Artificial Sequence: Synthetic peptide
  Seed: HSSSAFTITDQVPFSVSVSQL (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVSQL

SEQ ID NO: 328873 - protein, 21 aa, Artificial Sequence
  Description of Artificial Sequence: Synthetic peptide
  Seed: HSSSAFTITDQVPFSVSVSQL (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVSQL

SEQ ID NO: 328874 - protein, 21 aa, Artificial Sequence
  Description of Artificial Sequence: Synthetic peptide
  Seed: HSSSAFTITDQVPFSVSVSQL (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVSQL

SEQ ID NO: 328875 - protein, 21 aa, Artificial Sequence
  Description of Artificial Sequence: Synthetic peptide
  Seed: HSSSAFTITDQVPFSVSVSQL (PMEL_HUMAN)
  Core: QVPFSVSVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDXVPXSXSVXQL

SEQ ID NO: 328876 - protein, 22 aa, Artificial Sequence
  Description of Artificial Sequence: Synthetic peptide
  Seed: HSSSAFTITDQVPFSVSVSQLR (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVSQLR

SEQ ID NO: 328877 - protein, 22 aa, Artificial Sequence
  Description of Artificial Sequence: Synthetic peptide
  Seed: HSSSAFTITDQVPFSVSVSQLR (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVSQLR

SEQ ID NO: 328878 - protein, 22 aa, Artificial Sequence
  Description of Artificial Sequence: Synthetic peptide
  Seed: HSSSAFTITDQVPFSVSVSQLR (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVSQLR

SEQ ID NO: 328879 - protein, 22 aa, Artificial Sequence
  Description of Artificial Sequence: Synthetic peptide
  Seed: HSSSAFTITDQVPFSVSVSQLR (PMEL_HUMAN)
  Core: QVPFSVSVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDXVPXSXSVXQLR

SEQ ID NO: 328880 - protein, 22 aa, Artificial Sequence
  Description of Artificial Sequence: Synthetic peptide
  Seed: HSSSAFTITDQVPFSVSVSQLR (PMEL_HUMAN)
  Core: PFSVSVSQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVXFSXSXSQXR

SEQ ID NO: 328881 - protein, 23 aa, Artificial Sequence
  Description of Artificial Sequence: Synthetic peptide
  Seed: HSSSAFTITDQVPFSVSVSQLRA (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVSQLRA

SEQ ID NO: 328882 - protein, 23 aa, Artificial Sequence
  Description of Artificial Sequence: Synthetic peptide
  Seed: HSSSAFTITDQVPFSVSVSQLRA (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVSQLRA

SEQ ID NO: 328883 - protein, 23 aa, Artificial Sequence
  Description of Artificial Sequence: Synthetic peptide
  Seed: HSSSAFTITDQVPFSVSVSQLRA (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVSQLRA

SEQ ID NO: 328884 - protein, 23 aa, Artificial Sequence
  Description of Artificial Sequence: Synthetic peptide
  Seed: HSSSAFTITDQVPFSVSVSQLRA (PMEL_HUMAN)
  Core: QVPFSVSVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDXVPXSXSVXQLRA

SEQ ID NO: 328885 - protein, 23 aa, Artificial Sequence
  Description of Artificial Sequence: Synthetic peptide
  Seed: HSSSAFTITDQVPFSVSVSQLRA (PMEL_HUMAN)
  Core: PFSVSVSQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVXFSXSXSQXRA

SEQ ID NO: 328886 - protein, 23 aa, Artificial Sequence
  Description of Artificial Sequence: Synthetic peptide
  Seed: HSSSAFTITDQVPFSVSVSQLRA (PMEL_HUMAN)
  Core: FSVSVSQLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVPXSVXVXQLXA

SEQ ID NO: 328887 - protein, 24 aa, Artificial Sequence
  Description of Artificial Sequence: Synthetic peptide
  Seed: HSSSAFTITDQVPFSVSVSQLRAL (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVSQLRAL

SEQ ID NO: 328888 - protein, 24 aa, Artificial Sequence
  Description of Artificial Sequence: Synthetic peptide
  Seed: HSSSAFTITDQVPFSVSVSQLRAL (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVSQLRAL

SEQ ID NO: 328889 - protein, 24 aa, Artificial Sequence
  Description of Artificial Sequence: Synthetic peptide
  Seed: HSSSAFTITDQVPFSVSVSQLRAL (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVSQLRAL

SEQ ID NO: 328890 - protein, 24 aa, Artificial Sequence
  Description of Artificial Sequence: Synthetic peptide
  Seed: HSSSAFTITDQVPFSVSVSQLRAL (PMEL_HUMAN)
  Core: QVPFSVSVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDXVPXSXSVXQLRAL

SEQ ID NO: 328891 - protein, 24 aa, Artificial Sequence
  Description of Artificial Sequence: Synthetic peptide
  Seed: HSSSAFTITDQVPFSVSVSQLRAL (PMEL_HUMAN)
  Core: PFSVSVSQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVXFSXSXSQXRAL

SEQ ID NO: 328892 - protein, 24 aa, Artificial Sequence
  Description of Artificial Sequence: Synthetic peptide
  Seed: HSSSAFTITDQVPFSVSVSQLRAL (PMEL_HUMAN)
  Core: FSVSVSQLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVPXSVXVXQLXAL

SEQ ID NO: 328893 - protein, 25 aa, Artificial Sequence
  Description of Artificial Sequence: Synthetic peptide
  Seed: HSSSAFTITDQVPFSVSVSQLRALD (PMEL_HUMAN)
  Core: SAFTITDQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXAFXIXDQXPFSVSVSQLRALD

SEQ ID NO: 328894 - protein, 25 aa, Artificial Sequence
  Description of Artificial Sequence: Synthetic peptide
  Seed: HSSSAFTITDQVPFSVSVSQLRALD (PMEL_HUMAN)
  Core: FTITDQVPF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAXTIXDXVPXSVSVSQLRALD

SEQ ID NO: 328895 - protein, 25 aa, Artificial Sequence
  Description of Artificial Sequence: Synthetic peptide
  Seed: HSSSAFTITDQVPFSVSVSQLRALD (PMEL_HUMAN)
  Core: ITDQVPFSV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTXTDXVXFSXSVSQLRALD

SEQ ID NO: 328896 - protein, 25 aa, Artificial Sequence
  Description of Artificial Sequence: Synthetic peptide
  Seed: HSSSAFTITDQVPFSVSVSQLRALD (PMEL_HUMAN)
  Core: QVPFSVSVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDXVPXSXSVXQLRALD

SEQ ID NO: 328897 - protein, 25 aa, Artificial Sequence
  Description of Artificial Sequence: Synthetic peptide
  Seed: HSSSAFTITDQVPFSVSVSQLRALD (PMEL_HUMAN)
  Core: PFSVSVSQL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVXFSXSXSQXRALD

SEQ ID NO: 328898 - protein, 25 aa, Artificial Sequence
  Description of Artificial Sequence: Synthetic peptide
  Seed: HSSSAFTITDQVPFSVSVSQLRALD (PMEL_HUMAN)
  Core: FSVSVSQLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVPXSVXVXQLXALD

SEQ ID NO: 328899 - protein, 25 aa, Artificial Sequence
  Description of Artificial Sequence: Synthetic peptide
  Seed: HSSSAFTITDQVPFSVSVSQLRALD (PMEL_HUMAN)
  Core: VSVSQLRAL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
HSSSAFTITDQVPFSXSVXQXRAXD

SEQ ID NO: 328900 - protein, 14 aa, Artificial Sequence
  Description of Artificial Sequence: Synthetic peptide
  Seed: HSSSHWLRLPRIFC (PMEL_HUMAN)
  Core: SSHWLRLPR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HSXSHXLXLPXIFC

SEQ ID NO: 328901 - protein, 15 aa, Artificial Sequence
  Description of Artificial Sequence: Synthetic peptide
  Seed: HSSSHWLRLPRIFCS (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCS

SEQ ID NO: 328902 - protein, 15 aa, Artificial Sequence
  Description of Artificial Sequence: Synthetic peptide
  Seed: HSSSHWLRLPRIFCS (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXS

SEQ ID NO: 328903 - protein, 16 aa, Artificial Sequence
  Description of Artificial Sequence: Synthetic peptide
  Seed: HSSSHWLRLPRIFCSC (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSC

SEQ ID NO: 328904 - protein, 16 aa, Artificial Sequence
  Description of Artificial Sequence: Synthetic peptide
  Seed: HSSSHWLRLPRIFCSC (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSC

SEQ ID NO: 328905 - protein, 17 aa, Artificial Sequence
  Description of Artificial Sequence: Synthetic peptide
  Seed: HSSSHWLRLPRIFCSCP (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSCP

SEQ ID NO: 328906 - protein, 17 aa, Artificial Sequence
  Description of Artificial Sequence: Synthetic peptide
  Seed: HSSSHWLRLPRIFCSCP (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCP

SEQ ID NO: 328907 - protein, 18 aa, Artificial Sequence
  Description of Artificial Sequence: Synthetic peptide
  Seed: HSSSHWLRLPRIFCSCPI (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSCPI

SEQ ID NO: 328908 - protein, 19 aa, Artificial Sequence
  Description of Artificial Sequence: Synthetic peptide
  Seed: HSSSHWLRLPRIFCSCPIG (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSCPIG

SEQ ID NO: 328909 - protein, 19 aa, Artificial Sequence
  Description of Artificial Sequence: Synthetic peptide
  Seed: HSSSHWLRLPRIFCSCPIG (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIG

SEQ ID NO: 328910 - protein, 19 aa, Artificial Sequence
  Description of Artificial Sequence: Synthetic peptide
  Seed: HSSSHWLRLPRIFCSCPIG (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXG

SEQ ID NO: 328911 - protein, 20 aa, Artificial Sequence
  Description of Artificial Sequence: Synthetic peptide
  Seed: HSSSHWLRLPRIFCSCPIGE (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSCPIGE

SEQ ID NO: 328912 - protein, 20 aa, Artificial Sequence
  Description of Artificial Sequence: Synthetic peptide
  Seed: HSSSHWLRLPRIFCSCPIGE (PMEL_HUMAN)
  Core: HWLRLPRIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HSSSXWLXLXRIXCSCPIGE

SEQ ID NO: 328913 - protein, 20 aa, Artificial Sequence
  Description of Artificial Sequence: Synthetic peptide
  Seed: HSSSHWLRLPRIFCSCPIGE (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIGE

SEQ ID NO: 328914 - protein, 20 aa, Artificial Sequence
  Description of Artificial Sequence: Synthetic peptide
  Seed: HSSSHWLRLPRIFCSCPIGE (PMEL_HUMAN)
  Core: RLPRIFCSC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLXLPXIXCSXPIGE

SEQ ID NO: 328915 - protein, 20 aa, Artificial Sequence
  Description of Artificial Sequence: Synthetic peptide
  Seed: HSSSHWLRLPRIFCSCPIGE (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXGE

SEQ ID NO: 328916 - protein, 20 aa, Artificial Sequence
  Description of Artificial Sequence: Synthetic peptide
  Seed: HSSSHWLRLPRIFCSCPIGE (PMEL_HUMAN)
  Core: RIFCSCPIG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPXIFXSXPIXE

SEQ ID NO: 328917 - protein, 21 aa, Artificial Sequence
  Description of Artificial Sequence: Synthetic peptide
  Seed: HSSSHWLRLPRIFCSCPIGEN (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSCPIGEN

SEQ ID NO: 328918 - protein, 21 aa, Artificial Sequence
  Description of Artificial Sequence: Synthetic peptide
  Seed: HSSSHWLRLPRIFCSCPIGEN (PMEL_HUMAN)
  Core: HWLRLPRIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HSSSXWLXLXRIXCSCPIGEN

SEQ ID NO: 328919 - protein, 21 aa, Artificial Sequence
  Description of Artificial Sequence: Synthetic peptide
  Seed: HSSSHWLRLPRIFCSCPIGEN (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIGEN

SEQ ID NO: 328920 - protein, 21 aa, Artificial Sequence
  Description of Artificial Sequence: Synthetic peptide
  Seed: HSSSHWLRLPRIFCSCPIGEN (PMEL_HUMAN)
  Core: RLPRIFCSC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLXLPXIXCSXPIGEN

SEQ ID NO: 328921 - protein, 21 aa, Artificial Sequence
  Description of Artificial Sequence: Synthetic peptide
  Seed: HSSSHWLRLPRIFCSCPIGEN (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXGEN

SEQ ID NO: 328922 - protein, 21 aa, Artificial Sequence
  Description of Artificial Sequence: Synthetic peptide
  Seed: HSSSHWLRLPRIFCSCPIGEN (PMEL_HUMAN)
  Core: RIFCSCPIG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPXIFXSXPIXEN

SEQ ID NO: 328923 - protein, 22 aa, Artificial Sequence
  Description of Artificial Sequence: Synthetic peptide
  Seed: HSSSHWLRLPRIFCSCPIGENS (PMEL_HUMAN)
  Core: SHWLRLPRI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HSSXHWXRXPRXFCSCPIGENS

SEQ ID NO: 328924 - protein, 22 aa, Artificial Sequence
  Description of Artificial Sequence: Synthetic peptide
  Seed: HSSSHWLRLPRIFCSCPIGENS (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIGENS

SEQ ID NO: 328925 - protein, 22 aa, Artificial Sequence
  Description of Artificial Sequence: Synthetic peptide
  Seed: HSSSHWLRLPRIFCSCPIGENS (PMEL_HUMAN)
  Core: RLPRIFCSC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLXLPXIXCSXPIGENS

SEQ ID NO: 328926 - protein, 22 aa, Artificial Sequence
  Description of Artificial Sequence: Synthetic peptide
  Seed: HSSSHWLRLPRIFCSCPIGENS (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXGENS

SEQ ID NO: 328927 - protein, 22 aa, Artificial Sequence
  Description of Artificial Sequence: Synthetic peptide
  Seed: HSSSHWLRLPRIFCSCPIGENS (PMEL_HUMAN)
  Core: RIFCSCPIG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPXIFXSXPIXENS

SEQ ID NO: 328928 - protein, 22 aa, Artificial Sequence
  Description of Artificial Sequence: Synthetic peptide
  Seed: HSSSHWLRLPRIFCSCPIGENS (PMEL_HUMAN)
  Core: IFCSCPIGE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRXFCXCXIGXNS

SEQ ID NO: 328929 - protein, 23 aa, Artificial Sequence
  Description of Artificial Sequence: Synthetic peptide
  Seed: HSSSHWLRLPRIFCSCPIGENSP (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIGENSP

SEQ ID NO: 328930 - protein, 23 aa, Artificial Sequence
  Description of Artificial Sequence: Synthetic peptide
  Seed: HSSSHWLRLPRIFCSCPIGENSP (PMEL_HUMAN)
  Core: RLPRIFCSC
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLXLPXIXCSXPIGENSP

SEQ ID NO: 328931 - protein, 23 aa, Artificial Sequence
  Description of Artificial Sequence: Synthetic peptide
  Seed: HSSSHWLRLPRIFCSCPIGENSP (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXGENSP

SEQ ID NO: 328932 - protein, 23 aa, Artificial Sequence
  Description of Artificial Sequence: Synthetic peptide
  Seed: HSSSHWLRLPRIFCSCPIGENSP (PMEL_HUMAN)
  Core: RIFCSCPIG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPXIFXSXPIXENSP

SEQ ID NO: 328933 - protein, 23 aa, Artificial Sequence
  Description of Artificial Sequence: Synthetic peptide
  Seed: HSSSHWLRLPRIFCSCPIGENSP (PMEL_HUMAN)
  Core: IFCSCPIGE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRXFCXCXIGXNSP

SEQ ID NO: 328934 - protein, 23 aa, Artificial Sequence
  Description of Artificial Sequence: Synthetic peptide
  Seed: HSSSHWLRLPRIFCSCPIGENSP (PMEL_HUMAN)
  Core: FCSCPIGEN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRIXCSXPXGEXSP

SEQ ID NO: 328935 - protein, 24 aa, Artificial Sequence
  Description of Artificial Sequence: Synthetic peptide
  Seed: HSSSHWLRLPRIFCSCPIGENSPL (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIGENSPL

SEQ ID NO: 328936 - protein, 24 aa, Artificial Sequence
  Description of Artificial Sequence: Synthetic peptide
  Seed: HSSSHWLRLPRIFCSCPIGENSPL (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXGENSPL

SEQ ID NO: 328937 - protein, 24 aa, Artificial Sequence
  Description of Artificial Sequence: Synthetic peptide
  Seed: HSSSHWLRLPRIFCSCPIGENSPL (PMEL_HUMAN)
  Core: RIFCSCPIG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPXIFXSXPIXENSPL

SEQ ID NO: 328938 - protein, 24 aa, Artificial Sequence
  Description of Artificial Sequence: Synthetic peptide
  Seed: HSSSHWLRLPRIFCSCPIGENSPL (PMEL_HUMAN)
  Core: IFCSCPIGE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRXFCXCXIGXNSPL

SEQ ID NO: 328939 - protein, 24 aa, Artificial Sequence
  Description of Artificial Sequence: Synthetic peptide
  Seed: HSSSHWLRLPRIFCSCPIGENSPL (PMEL_HUMAN)
  Core: FCSCPIGEN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRIXCSXPXGEXSPL

SEQ ID NO: 328940 - protein, 25 aa, Artificial Sequence
  Description of Artificial Sequence: Synthetic peptide
  Seed: HSSSHWLRLPRIFCSCPIGENSPLL (PMEL_HUMAN)
  Core: WLRLPRIFC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHXLRXPXIFXSCPIGENSPLL

SEQ ID NO: 328941 - protein, 25 aa, Artificial Sequence
  Description of Artificial Sequence: Synthetic peptide
  Seed: HSSSHWLRLPRIFCSCPIGENSPLL (PMEL_HUMAN)
  Core: PRIFCSCPI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLXRIXCXCPXGENSPLL

SEQ ID NO: 328942 - protein, 25 aa, Artificial Sequence
  Description of Artificial Sequence: Synthetic peptide
  Seed: HSSSHWLRLPRIFCSCPIGENSPLL (PMEL_HUMAN)
  Core: RIFCSCPIG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPXIFXSXPIXENSPLL

SEQ ID NO: 328943 - protein, 25 aa, Artificial Sequence
  Description of Artificial Sequence: Synthetic peptide
  Seed: HSSSHWLRLPRIFCSCPIGENSPLL (PMEL_HUMAN)
  Core: IFCSCPIGE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRXFCXCXIGXNSPLL

SEQ ID NO: 328944 - protein, 25 aa, Artificial Sequence
  Description of Artificial Sequence: Synthetic peptide
  Seed: HSSSHWLRLPRIFCSCPIGENSPLL (PMEL_HUMAN)
  Core: FCSCPIGEN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HSSSHWLRLPRIXCSXPXGEXSPLL

SEQ ID NO: 328945 - protein, 14 aa, Artificial Sequence
  Description of Artificial Sequence: Synthetic peptide
  Seed: HTMEVTVYHRRGSR (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXR

SEQ ID NO: 328946 - protein, 15 aa, Artificial Sequence
  Description of Artificial Sequence: Synthetic peptide
  Seed: HTMEVTVYHRRGSRS (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRS

SEQ ID NO: 328947 - protein, 16 aa, Artificial Sequence
  Description of Artificial Sequence: Synthetic peptide
  Seed: HTMEVTVYHRRGSRSY (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSY

SEQ ID NO: 328948 - protein, 17 aa, Artificial Sequence
  Description of Artificial Sequence: Synthetic peptide
  Seed: HTMEVTVYHRRGSRSYV (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYV

SEQ ID NO: 328949 - protein, 18 aa, Artificial Sequence
  Description of Artificial Sequence: Synthetic peptide
  Seed: HTMEVTVYHRRGSRSYVP (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVP

SEQ ID NO: 328950 - protein, 19 aa, Artificial Sequence
  Description of Artificial Sequence: Synthetic peptide
  Seed: HTMEVTVYHRRGSRSYVPL (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPL

SEQ ID NO: 328951 - protein, 20 aa, Artificial Sequence
  Description of Artificial Sequence: Synthetic peptide
  Seed: HTMEVTVYHRRGSRSYVPLA (PMEL_HUMAN)
  Core: MEVTVYHRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXEVXVXHRXGSRSYVPLA

SEQ ID NO: 328952 - protein, 20 aa, Artificial Sequence
  Description of Artificial Sequence: Synthetic peptide
  Seed: HTMEVTVYHRRGSRSYVPLA (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPLA

SEQ ID NO: 328953 - protein, 20 aa, Artificial Sequence
  Description of Artificial Sequence: Synthetic peptide
  Seed: HTMEVTVYHRRGSRSYVPLA (PMEL_HUMAN)
  Core: VYHRRGSRS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTXYHXRXSRXYVPLA

SEQ ID NO: 328954 - protein, 20 aa, Artificial Sequence
  Description of Artificial Sequence: Synthetic peptide
  Seed: HTMEVTVYHRRGSRSYVPLA (PMEL_HUMAN)
  Core: YHRRGSRSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVXHRXGXRSXVPLA

SEQ ID NO: 328955 - protein, 20 aa, Artificial Sequence
  Description of Artificial Sequence: Synthetic peptide
  Seed: HTMEVTVYHRRGSRSYVPLA (PMEL_HUMAN)
  Core: RRGSRSYVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHXRGXRXYVXLA

SEQ ID NO: 328956 - protein, 21 aa, Artificial Sequence
  Description of Artificial Sequence: Synthetic peptide
  Seed: HTMEVTVYHRRGSRSYVPLAH (PMEL_HUMAN)
  Core: MEVTVYHRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXEVXVXHRXGSRSYVPLAH

SEQ ID NO: 328957 - protein, 21 aa, Artificial Sequence
  Description of Artificial Sequence: Synthetic peptide
  Seed: HTMEVTVYHRRGSRSYVPLAH (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPLAH

SEQ ID NO: 328958 - protein, 21 aa, Artificial Sequence
  Description of Artificial Sequence: Synthetic peptide
  Seed: HTMEVTVYHRRGSRSYVPLAH (PMEL_HUMAN)
  Core: YHRRGSRSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVXHRXGXRSXVPLAH

SEQ ID NO: 328959 - protein, 21 aa, Artificial Sequence
  Description of Artificial Sequence: Synthetic peptide
  Seed: HTMEVTVYHRRGSRSYVPLAH (PMEL_HUMAN)
  Core: RRGSRSYVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHXRGXRXYVXLAH

SEQ ID NO: 328960 - protein, 22 aa, Artificial Sequence
  Description of Artificial Sequence: Synthetic peptide
  Seed: HTMEVTVYHRRGSRSYVPLAHS (PMEL_HUMAN)
  Core: MEVTVYHRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXEVXVXHRXGSRSYVPLAHS

SEQ ID NO: 328961 - protein, 22 aa, Artificial Sequence
  Description of Artificial Sequence: Synthetic peptide
  Seed: HTMEVTVYHRRGSRSYVPLAHS (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPLAHS

SEQ ID NO: 328962 - protein, 22 aa, Artificial Sequence
  Description of Artificial Sequence: Synthetic peptide
  Seed: HTMEVTVYHRRGSRSYVPLAHS (PMEL_HUMAN)
  Core: YHRRGSRSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVXHRXGXRSXVPLAHS

SEQ ID NO: 328963 - protein, 22 aa, Artificial Sequence
  Description of Artificial Sequence: Synthetic peptide
  Seed: HTMEVTVYHRRGSRSYVPLAHS (PMEL_HUMAN)
  Core: GSRSYVPLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRXSRXYXPLXHS

SEQ ID NO: 328964 - protein, 22 aa, Artificial Sequence
  Description of Artificial Sequence: Synthetic peptide
  Seed: HTMEVTVYHRRGSRSYVPLAHS (PMEL_HUMAN)
  Core: SRSYVPLAH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGXRSXVXLAXS

SEQ ID NO: 328965 - protein, 22 aa, Artificial Sequence
  Description of Artificial Sequence: Synthetic peptide
  Seed: HTMEVTVYHRRGSRSYVPLAHS (PMEL_HUMAN)
  Core: RSYVPLAHS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGSXSYXPXAHX

SEQ ID NO: 328966 - protein, 23 aa, Artificial Sequence
  Description of Artificial Sequence: Synthetic peptide
  Seed: HTMEVTVYHRRGSRSYVPLAHSS (PMEL_HUMAN)
  Core: MEVTVYHRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXEVXVXHRXGSRSYVPLAHSS

SEQ ID NO: 328967 - protein, 23 aa, Artificial Sequence
  Description of Artificial Sequence: Synthetic peptide
  Seed: HTMEVTVYHRRGSRSYVPLAHSS (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPLAHSS

SEQ ID NO: 328968 - protein, 23 aa, Artificial Sequence
  Description of Artificial Sequence: Synthetic peptide
  Seed: HTMEVTVYHRRGSRSYVPLAHSS (PMEL_HUMAN)
  Core: YHRRGSRSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVXHRXGXRSXVPLAHSS

SEQ ID NO: 328969 - protein, 23 aa, Artificial Sequence
  Description of Artificial Sequence: Synthetic peptide
  Seed: HTMEVTVYHRRGSRSYVPLAHSS (PMEL_HUMAN)
  Core: GSRSYVPLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRXSRXYXPLXHSS

SEQ ID NO: 328970 - protein, 23 aa, Artificial Sequence
  Description of Artificial Sequence: Synthetic peptide
  Seed: HTMEVTVYHRRGSRSYVPLAHSS (PMEL_HUMAN)
  Core: SRSYVPLAH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGXRSXVXLAXSS

SEQ ID NO: 328971 - protein, 23 aa, Artificial Sequence
  Description of Artificial Sequence: Synthetic peptide
  Seed: HTMEVTVYHRRGSRSYVPLAHSS (PMEL_HUMAN)
  Core: RSYVPLAHS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGSXSYXPXAHXS

SEQ ID NO: 328972 - protein, 24 aa, Artificial Sequence
  Description of Artificial Sequence: Synthetic peptide
  Seed: HTMEVTVYHRRGSRSYVPLAHSSS (PMEL_HUMAN)
  Core: MEVTVYHRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXEVXVXHRXGSRSYVPLAHSSS

SEQ ID NO: 328973 - protein, 24 aa, Artificial Sequence
  Description of Artificial Sequence: Synthetic peptide
  Seed: HTMEVTVYHRRGSRSYVPLAHSSS (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPLAHSSS

SEQ ID NO: 328974 - protein, 24 aa, Artificial Sequence
  Description of Artificial Sequence: Synthetic peptide
  Seed: HTMEVTVYHRRGSRSYVPLAHSSS (PMEL_HUMAN)
  Core: YHRRGSRSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVXHRXGXRSXVPLAHSSS

SEQ ID NO: 328975 - protein, 24 aa, Artificial Sequence
  Description of Artificial Sequence: Synthetic peptide
  Seed: HTMEVTVYHRRGSRSYVPLAHSSS (PMEL_HUMAN)
  Core: GSRSYVPLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRXSRXYXPLXHSSS

SEQ ID NO: 328976 - protein, 24 aa, Artificial Sequence
  Description of Artificial Sequence: Synthetic peptide
  Seed: HTMEVTVYHRRGSRSYVPLAHSSS (PMEL_HUMAN)
  Core: SRSYVPLAH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGXRSXVXLAXSSS

SEQ ID NO: 328977 - protein, 24 aa, Artificial Sequence
  Description of Artificial Sequence: Synthetic peptide
  Seed: HTMEVTVYHRRGSRSYVPLAHSSS (PMEL_HUMAN)
  Core: RSYVPLAHS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGSXSYXPXAHXSS

SEQ ID NO: 328978 - protein, 24 aa, Artificial Sequence
  Description of Artificial Sequence: Synthetic peptide
  Seed: HTMEVTVYHRRGSRSYVPLAHSSS (PMEL_HUMAN)
  Core: YVPLAHSSS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGSRSXVPXAXSSX

SEQ ID NO: 328979 - protein, 25 aa, Artificial Sequence
  Description of Artificial Sequence: Synthetic peptide
  Seed: HTMEVTVYHRRGSRSYVPLAHSSSA (PMEL_HUMAN)
  Core: MEVTVYHRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXEVXVXHRXGSRSYVPLAHSSSA

SEQ ID NO: 328980 - protein, 25 aa, Artificial Sequence
  Description of Artificial Sequence: Synthetic peptide
  Seed: HTMEVTVYHRRGSRSYVPLAHSSSA (PMEL_HUMAN)
  Core: VTVYHRRGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
HTMEXTVXHXRGXRSYVPLAHSSSA

SEQ ID NO: 328981 - protein, 25 aa, Artificial Sequence
  Description of Artificial Sequence: Synthetic peptide
  Seed: HTMEVTVYHRRGSRSYVPLAHSSSA (PMEL_HUMAN)
  Core: YHRRGSRSY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVXHRXGXRSXVPLAHSSSA

SEQ ID NO: 328982 - protein, 25 aa, Artificial Sequence
  Description of Artificial Sequence: Synthetic peptide
  Seed: HTMEVTVYHRRGSRSYVPLAHSSSA (PMEL_HUMAN)
  Core: GSRSYVPLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRXSRXYXPLXHSSSA

SEQ ID NO: 328983 - protein, 25 aa, Artificial Sequence
  Description of Artificial Sequence: Synthetic peptide
  Seed: HTMEVTVYHRRGSRSYVPLAHSSSA (PMEL_HUMAN)
  Core: SRSYVPLAH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGXRSXVXLAXSSSA

SEQ ID NO: 328984 - protein, 25 aa, Artificial Sequence
  Description of Artificial Sequence: Synthetic peptide
  Seed: HTMEVTVYHRRGSRSYVPLAHSSSA (PMEL_HUMAN)
  Core: RSYVPLAHS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGSXSYXPXAHXSSA

SEQ ID NO: 328985 - protein, 25 aa, Artificial Sequence
  Description of Artificial Sequence: Synthetic peptide
  Seed: HTMEVTVYHRRGSRSYVPLAHSSSA (PMEL_HUMAN)
  Core: YVPLAHSSS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
HTMEVTVYHRRGSRSXVPXAXSSXA

SEQ ID NO: 328986 - protein, 14 aa, Artificial Sequence
  Description of Artificial Sequence: Synthetic peptide
  Seed: HTYLEPGPVTAQVV (PMEL_HUMAN)
  Core: LEPGPVTAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HTYXEPXPXTAXVV

SEQ ID NO: 328987 - protein, 14 aa, Artificial Sequence
  Description of Artificial Sequence: Synthetic peptide
  Seed: HTYLEPGPVTAQVV (PMEL_HUMAN)
  Core: PGPVTAQVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEXGPXTXQVX

SEQ ID NO: 328988 - protein, 15 aa, Artificial Sequence
  Description of Artificial Sequence: Synthetic peptide
  Seed: HTYLEPGPVTAQVVL (PMEL_HUMAN)
  Core: YLEPGPVTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HTXLEXGXVTXQVVL

SEQ ID NO: 328989 - protein, 15 aa, Artificial Sequence
  Description of Artificial Sequence: Synthetic peptide
  Seed: HTYLEPGPVTAQVVL (PMEL_HUMAN)
  Core: LEPGPVTAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HTYXEPXPXTAXVVL

SEQ ID NO: 328990 - protein, 15 aa, Artificial Sequence
  Description of Artificial Sequence: Synthetic peptide
  Seed: HTYLEPGPVTAQVVL (PMEL_HUMAN)
  Core: PGPVTAQVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEXGPXTXQVXL

SEQ ID NO: 328991 - protein, 16 aa, Artificial Sequence
  Description of Artificial Sequence: Synthetic peptide
  Seed: HTYLEPGPVTAQVVLQ (PMEL_HUMAN)
  Core: LEPGPVTAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HTYXEPXPXTAXVVLQ

SEQ ID NO: 328992 - protein, 16 aa, Artificial Sequence
  Description of Artificial Sequence: Synthetic peptide
  Seed: HTYLEPGPVTAQVVLQ (PMEL_HUMAN)
  Core: PGPVTAQVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEXGPXTXQVXLQ

SEQ ID NO: 328993 - protein, 16 aa, Artificial Sequence
  Description of Artificial Sequence: Synthetic peptide
  Seed: HTYLEPGPVTAQVVLQ (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLX

SEQ ID NO: 328994 - protein, 17 aa, Artificial Sequence
  Description of Artificial Sequence: Synthetic peptide
  Seed: HTYLEPGPVTAQVVLQA (PMEL_HUMAN)
  Core: LEPGPVTAQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
HTYXEPXPXTAXVVLQA

SEQ ID NO: 328995 - protein, 17 aa, Artificial Sequence
  Description of Artificial Sequence: Synthetic peptide
  Seed: HTYLEPGPVTAQVVLQA (PMEL_HUMAN)
  Core: PGPVTAQVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEXGPXTXQVXLQA

SEQ ID NO: 328996 - protein, 17 aa, Artificial Sequence
  Description of Artificial Sequence: Synthetic peptide
  Seed: HTYLEPGPVTAQVVLQA (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXA

SEQ ID NO: 328997 - protein, 17 aa, Artificial Sequence
  Description of Artificial Sequence: Synthetic peptide
  Seed: HTYLEPGPVTAQVVLQA (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQX

SEQ ID NO: 328998 - protein, 18 aa, Artificial Sequence
  Description of Artificial Sequence: Synthetic peptide
  Seed: HTYLEPGPVTAQVVLQAA (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAA

SEQ ID NO: 328999 - protein, 18 aa, Artificial Sequence
  Description of Artificial Sequence: Synthetic peptide
  Seed: HTYLEPGPVTAQVVLQAA (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXA

SEQ ID NO: 329000 - protein, 19 aa, Artificial Sequence
  Description of Artificial Sequence: Synthetic peptide
  Seed: HTYLEPGPVTAQVVLQAAI (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAI

SEQ ID NO: 329001 - protein, 19 aa, Artificial Sequence
  Description of Artificial Sequence: Synthetic peptide
  Seed: HTYLEPGPVTAQVVLQAAI (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAI

SEQ ID NO: 329002 - protein, 19 aa, Artificial Sequence
  Description of Artificial Sequence: Synthetic peptide
  Seed: HTYLEPGPVTAQVVLQAAI (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXI

SEQ ID NO: 329003 - protein, 20 aa, Artificial Sequence
  Description of Artificial Sequence: Synthetic peptide
  Seed: HTYLEPGPVTAQVVLQAAIP (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAIP

SEQ ID NO: 329004 - protein, 20 aa, Artificial Sequence
  Description of Artificial Sequence: Synthetic peptide
  Seed: HTYLEPGPVTAQVVLQAAIP (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAIP

SEQ ID NO: 329005 - protein, 20 aa, Artificial Sequence
  Description of Artificial Sequence: Synthetic peptide
  Seed: HTYLEPGPVTAQVVLQAAIP (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXIP

SEQ ID NO: 329006 - protein, 21 aa, Artificial Sequence
  Description of Artificial Sequence: Synthetic peptide
  Seed: HTYLEPGPVTAQVVLQAAIPL (PMEL_HUMAN)
  Core: PGPVTAQVV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEXGPXTXQVXLQAAIPL

SEQ ID NO: 329007 - protein, 21 aa, Artificial Sequence
  Description of Artificial Sequence: Synthetic peptide
  Seed: HTYLEPGPVTAQVVLQAAIPL (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAIPL

SEQ ID NO: 329008 - protein, 21 aa, Artificial Sequence
  Description of Artificial Sequence: Synthetic peptide
  Seed: HTYLEPGPVTAQVVLQAAIPL (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAIPL

SEQ ID NO: 329009 - protein, 21 aa, Artificial Sequence
  Description of Artificial Sequence: Synthetic peptide
  Seed: HTYLEPGPVTAQVVLQAAIPL (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXIPL

SEQ ID NO: 329010 - protein, 22 aa, Artificial Sequence
  Description of Artificial Sequence: Synthetic peptide
  Seed: HTYLEPGPVTAQVVLQAAIPLT (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAIPLT

SEQ ID NO: 329011 - protein, 22 aa, Artificial Sequence
  Description of Artificial Sequence: Synthetic peptide
  Seed: HTYLEPGPVTAQVVLQAAIPLT (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAIPLT

SEQ ID NO: 329012 - protein, 22 aa, Artificial Sequence
  Description of Artificial Sequence: Synthetic peptide
  Seed: HTYLEPGPVTAQVVLQAAIPLT (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXIPLT

SEQ ID NO: 329013 - protein, 22 aa, Artificial Sequence
  Description of Artificial Sequence: Synthetic peptide
  Seed: HTYLEPGPVTAQVVLQAAIPLT (PMEL_HUMAN)
  Core: VVLQAAIPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVTAQXVLXAXIPXT

SEQ ID NO: 329014 - protein, 23 aa, Artificial Sequence
  Description of Artificial Sequence: Synthetic peptide
  Seed: HTYLEPGPVTAQVVLQAAIPLTS (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAIPLTS

SEQ ID NO: 329015 - protein, 23 aa, Artificial Sequence
  Description of Artificial Sequence: Synthetic peptide
  Seed: HTYLEPGPVTAQVVLQAAIPLTS (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAIPLTS

SEQ ID NO: 329016 - protein, 23 aa, Artificial Sequence
  Description of Artificial Sequence: Synthetic peptide
  Seed: HTYLEPGPVTAQVVLQAAIPLTS (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXIPLTS

SEQ ID NO: 329017 - protein, 23 aa, Artificial Sequence
  Description of Artificial Sequence: Synthetic peptide
  Seed: HTYLEPGPVTAQVVLQAAIPLTS (PMEL_HUMAN)
  Core: VVLQAAIPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVTAQXVLXAXIPXTS

SEQ ID NO: 329018 - protein, 24 aa, Artificial Sequence
  Description of Artificial Sequence: Synthetic peptide
  Seed: HTYLEPGPVTAQVVLQAAIPLTSC (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAIPLTSC

SEQ ID NO: 329019 - protein, 24 aa, Artificial Sequence
  Description of Artificial Sequence: Synthetic peptide
  Seed: HTYLEPGPVTAQVVLQAAIPLTSC (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAIPLTSC

SEQ ID NO: 329020 - protein, 24 aa, Artificial Sequence
  Description of Artificial Sequence: Synthetic peptide
  Seed: HTYLEPGPVTAQVVLQAAIPLTSC (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXIPLTSC

SEQ ID NO: 329021 - protein, 24 aa, Artificial Sequence
  Description of Artificial Sequence: Synthetic peptide
  Seed: HTYLEPGPVTAQVVLQAAIPLTSC (PMEL_HUMAN)
  Core: VVLQAAIPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVTAQXVLXAXIPXTSC

SEQ ID NO: 329022 - protein, 25 aa, Artificial Sequence
  Description of Artificial Sequence: Synthetic peptide
  Seed: HTYLEPGPVTAQVVLQAAIPLTSCG (PMEL_HUMAN)
  Core: PVTAQVVLQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGXVTXQXVLXAAIPLTSCG

SEQ ID NO: 329023 - protein, 25 aa, Artificial Sequence
  Description of Artificial Sequence: Synthetic peptide
  Seed: HTYLEPGPVTAQVVLQAAIPLTSCG (PMEL_HUMAN)
  Core: VTAQVVLQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPXTAXVXLQXAIPLTSCG

SEQ ID NO: 329024 - protein, 25 aa, Artificial Sequence
  Description of Artificial Sequence: Synthetic peptide
  Seed: HTYLEPGPVTAQVVLQAAIPLTSCG (PMEL_HUMAN)
  Core: TAQVVLQAA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVXAQXVXQAXIPLTSCG

SEQ ID NO: 329025 - protein, 25 aa, Artificial Sequence
  Description of Artificial Sequence: Synthetic peptide
  Seed: HTYLEPGPVTAQVVLQAAIPLTSCG (PMEL_HUMAN)
  Core: VVLQAAIPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVTAQXVLXAXIPXTSCG

SEQ ID NO: 329026 - protein, 25 aa, Artificial Sequence
  Description of Artificial Sequence: Synthetic peptide
  Seed: HTYLEPGPVTAQVVLQAAIPLTSCG (PMEL_HUMAN)
  Core: LQAAIPLTS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
HTYLEPGPVTAQVVXQAXIXLTXCG

SEQ ID NO: 329027 - protein, 14 aa, Artificial Sequence
  Description of Artificial Sequence: Synthetic peptide
  Seed: HWLRLPRIFCSCPI (PMEL_HUMAN)
  Core: LRLPRIFCS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HWXRLXRXFCXCPI

SEQ ID NO: 329028 - protein, 14 aa, Artificial Sequence
  Description of Artificial Sequence: Synthetic peptide
  Seed: HWLRLPRIFCSCPI (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPX

SEQ ID NO: 329029 - protein, 15 aa, Artificial Sequence
  Description of Artificial Sequence: Synthetic peptide
  Seed: HWLRLPRIFCSCPIG (PMEL_HUMAN)
  Core: WLRLPRIFC
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
HXLRXPXIFXSCPIG

SEQ ID NO: 329030 - protein, 15 aa, Artificial Sequence
  Description of Artificial Sequence: Synthetic peptide
  Seed: HWLRLPRIFCSCPIG (PMEL_HUMAN)
  Core: LRLPRIFCS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
HWXRLXRXFCXCPIG

SEQ ID NO: 329031 - protein, 15 aa, Artificial Sequence
  Description of Artificial Sequence: Synthetic peptide
  Seed: HWLRLPRIFCSCPIG (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXG

SEQ ID NO: 329032 - protein, 15 aa, Artificial Sequence
  Description of Artificial Sequence: Synthetic peptide
  Seed: HWLRLPRIFCSCPIG (PMEL_HUMAN)
  Core: RIFCSCPIG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPXIFXSXPIX

SEQ ID NO: 329033 - protein, 16 aa, Artificial Sequence
  Description of Artificial Sequence: Synthetic peptide
  Seed: HWLRLPRIFCSCPIGE (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGE

SEQ ID NO: 329034 - protein, 16 aa, Artificial Sequence
  Description of Artificial Sequence: Synthetic peptide
  Seed: HWLRLPRIFCSCPIGE (PMEL_HUMAN)
  Core: RIFCSCPIG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPXIFXSXPIXE

SEQ ID NO: 329035 - protein, 16 aa, Artificial Sequence
  Description of Artificial Sequence: Synthetic peptide
  Seed: HWLRLPRIFCSCPIGE (PMEL_HUMAN)
  Core: IFCSCPIGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRXFCXCXIGX

SEQ ID NO: 329036 - protein, 17 aa, Artificial Sequence
  Description of Artificial Sequence: Synthetic peptide
  Seed: HWLRLPRIFCSCPIGEN (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGEN

SEQ ID NO: 329037 - protein, 17 aa, Artificial Sequence
  Description of Artificial Sequence: Synthetic peptide
  Seed: HWLRLPRIFCSCPIGEN (PMEL_HUMAN)
  Core: RIFCSCPIG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPXIFXSXPIXEN

SEQ ID NO: 329038 - protein, 17 aa, Artificial Sequence
  Description of Artificial Sequence: Synthetic peptide
  Seed: HWLRLPRIFCSCPIGEN (PMEL_HUMAN)
  Core: IFCSCPIGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRXFCXCXIGXN

SEQ ID NO: 329039 - protein, 18 aa, Artificial Sequence
  Description of Artificial Sequence: Synthetic peptide
  Seed: HWLRLPRIFCSCPIGENS (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENS

SEQ ID NO: 329040 - protein, 19 aa, Artificial Sequence
  Description of Artificial Sequence: Synthetic peptide
  Seed: HWLRLPRIFCSCPIGENSP (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENSP

SEQ ID NO: 329041 - protein, 19 aa, Artificial Sequence
  Description of Artificial Sequence: Synthetic peptide
  Seed: HWLRLPRIFCSCPIGENSP (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSP

SEQ ID NO: 329042 - protein, 20 aa, Artificial Sequence
  Description of Artificial Sequence: Synthetic peptide
  Seed: HWLRLPRIFCSCPIGENSPL (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENSPL

SEQ ID NO: 329043 - protein, 20 aa, Artificial Sequence
  Description of Artificial Sequence: Synthetic peptide
  Seed: HWLRLPRIFCSCPIGENSPL (PMEL_HUMAN)
  Core: RIFCSCPIG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPXIFXSXPIXENSPL

SEQ ID NO: 329044 - protein, 20 aa, Artificial Sequence
  Description of Artificial Sequence: Synthetic peptide
  Seed: HWLRLPRIFCSCPIGENSPL (PMEL_HUMAN)
  Core: IFCSCPIGE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRXFCXCXIGXNSPL

SEQ ID NO: 329045 - protein, 20 aa, Artificial Sequence
  Description of Artificial Sequence: Synthetic peptide
  Seed: HWLRLPRIFCSCPIGENSPL (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSPL

SEQ ID NO: 329046 - protein, 21 aa, Artificial Sequence
  Description of Artificial Sequence: Synthetic peptide
  Seed: HWLRLPRIFCSCPIGENSPLL (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENSPLL

SEQ ID NO: 329047 - protein, 21 aa, Artificial Sequence
  Description of Artificial Sequence: Synthetic peptide
  Seed: HWLRLPRIFCSCPIGENSPLL (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSPLL

SEQ ID NO: 329048 - protein, 22 aa, Artificial Sequence
  Description of Artificial Sequence: Synthetic peptide
  Seed: HWLRLPRIFCSCPIGENSPLLS (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENSPLLS

SEQ ID NO: 329049 - protein, 22 aa, Artificial Sequence
  Description of Artificial Sequence: Synthetic peptide
  Seed: HWLRLPRIFCSCPIGENSPLLS (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSPLLS

SEQ ID NO: 329050 - protein, 23 aa, Artificial Sequence
  Description of Artificial Sequence: Synthetic peptide
  Seed: HWLRLPRIFCSCPIGENSPLLSG (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENSPLLSG

SEQ ID NO: 329051 - protein, 23 aa, Artificial Sequence
  Description of Artificial Sequence: Synthetic peptide
  Seed: HWLRLPRIFCSCPIGENSPLLSG (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSPLLSG

SEQ ID NO: 329052 - protein, 24 aa, Artificial Sequence
  Description of Artificial Sequence: Synthetic peptide
  Seed: HWLRLPRIFCSCPIGENSPLLSGQ (PMEL_HUMAN)
  Core: PRIFCSCPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLXRIXCXCPXGENSPLLSGQ

SEQ ID NO: 329053 - protein, 24 aa, Artificial Sequence
  Description of Artificial Sequence: Synthetic peptide
  Seed: HWLRLPRIFCSCPIGENSPLLSGQ (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSPLLSGQ

SEQ ID NO: 329054 - protein, 25 aa, Artificial Sequence
  Description of Artificial Sequence: Synthetic peptide
  Seed: HWLRLPRIFCSCPIGENSPLLSGQQ (PMEL_HUMAN)
  Core: FCSCPIGEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIXCSXPXGEXSPLLSGQQ

SEQ ID NO: 329055 - protein, 25 aa, Artificial Sequence
  Description of Artificial Sequence: Synthetic peptide
  Seed: HWLRLPRIFCSCPIGENSPLLSGQQ (PMEL_HUMAN)
  Core: IGENSPLLS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
HWLRLPRIFCSCPXGEXSXLLXGQQ

SEQ ID NO: 329056 - protein, 15 aa, Artificial Sequence
  Description of Artificial Sequence: Synthetic peptide
  Seed: IALNFPGSQKVLPDG (PMEL_HUMAN)
  Core: LNFPGSQKV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IAXNFXGXQKXLPDG

SEQ ID NO: 329057 - protein, 20 aa, Artificial Sequence
  Description of Artificial Sequence: Synthetic peptide
  Seed: IALNFPGSQKVLPDGQVIWV (PMEL_HUMAN)
  Core: QKVLPDGQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IALNFPGSXKVXPXGQXIWV

SEQ ID NO: 329058 - protein, 23 aa, Artificial Sequence
  Description of Artificial Sequence: Synthetic peptide
  Seed: IALNFPGSQKVLPDGQVIWVNNT (PMEL_HUMAN)
  Core: QKVLPDGQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IALNFPGSXKVXPXGQXIWVNNT

SEQ ID NO: 329059 - protein, 24 aa, Artificial Sequence
  Description of Artificial Sequence: Synthetic peptide
  Seed: IALNFPGSQKVLPDGQVIWVNNTI (PMEL_HUMAN)
  Core: QKVLPDGQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IALNFPGSXKVXPXGQXIWVNNTI

SEQ ID NO: 329060 - protein, 25 aa, Artificial Sequence
  Description of Artificial Sequence: Synthetic peptide
  Seed: IALNFPGSQKVLPDGQVIWVNNTII (PMEL_HUMAN)
  Core: VLPDGQVIW
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IALNFPGSQKXLPXGXVIXVNNTII

SEQ ID NO: 329061 - protein, 25 aa, Artificial Sequence
  Description of Artificial Sequence: Synthetic peptide
  Seed: IALNFPGSQKVLPDGQVIWVNNTII (PMEL_HUMAN)
  Core: QVIWVNNTI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
IALNFPGSQKVLPDGXVIXVXNTXI

SEQ ID NO: 329062 - protein, 13 aa, Artificial Sequence
  Description of Artificial Sequence: Synthetic peptide
  Seed: IESAEILQAVPSG (PMEL_HUMAN)
  Core: AEILQAVPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IESXEIXQXVPXG

SEQ ID NO: 329063 - protein, 14 aa, Artificial Sequence
  Description of Artificial Sequence: Synthetic peptide
  Seed: IESAEILQAVPSGE (PMEL_HUMAN)
  Core: ESAEILQAV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXSAXIXQAXPSGE

SEQ ID NO: 329064 - protein, 14 aa, Artificial Sequence
  Description of Artificial Sequence: Synthetic peptide
  Seed: IESAEILQAVPSGE (PMEL_HUMAN)
  Core: AEILQAVPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IESXEIXQXVPXGE

SEQ ID NO: 329065 - protein, 14 aa, Artificial Sequence
  Description of Artificial Sequence: Synthetic peptide
  Seed: IESAEILQAVPSGE (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGX

SEQ ID NO: 329066 - protein, 15 aa, Artificial Sequence
  Description of Artificial Sequence: Synthetic peptide
  Seed: IESAEILQAVPSGEG (PMEL_HUMAN)
  Core: AEILQAVPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IESXEIXQXVPXGEG

SEQ ID NO: 329067 - protein, 15 aa, Artificial Sequence
  Description of Artificial Sequence: Synthetic peptide
  Seed: IESAEILQAVPSGEG (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXG

SEQ ID NO: 329068 - protein, 16 aa, Artificial Sequence
  Description of Artificial Sequence: Synthetic peptide
  Seed: IESAEILQAVPSGEGD (PMEL_HUMAN)
  Core: AEILQAVPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IESXEIXQXVPXGEGD

SEQ ID NO: 329069 - protein, 16 aa, Artificial Sequence
  Description of Artificial Sequence: Synthetic peptide
  Seed: IESAEILQAVPSGEGD (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGD

SEQ ID NO: 329070 - protein, 17 aa, Artificial Sequence
  Description of Artificial Sequence: Synthetic peptide
  Seed: IESAEILQAVPSGEGDA (PMEL_HUMAN)
  Core: AEILQAVPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IESXEIXQXVPXGEGDA

SEQ ID NO: 329071 - protein, 17 aa, Artificial Sequence
  Description of Artificial Sequence: Synthetic peptide
  Seed: IESAEILQAVPSGEGDA (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDA

SEQ ID NO: 329072 - protein, 17 aa, Artificial Sequence
  Description of Artificial Sequence: Synthetic peptide
  Seed: IESAEILQAVPSGEGDA (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDA

SEQ ID NO: 329073 - protein, 18 aa, Artificial Sequence
  Description of Artificial Sequence: Synthetic peptide
  Seed: IESAEILQAVPSGEGDAF (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAF

SEQ ID NO: 329074 - protein, 19 aa, Artificial Sequence
  Description of Artificial Sequence: Synthetic peptide
  Seed: IESAEILQAVPSGEGDAFE (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFE

SEQ ID NO: 329075 - protein, 19 aa, Artificial Sequence
  Description of Artificial Sequence: Synthetic peptide
  Seed: IESAEILQAVPSGEGDAFE (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFE

SEQ ID NO: 329076 - protein, 20 aa, Artificial Sequence
  Description of Artificial Sequence: Synthetic peptide
  Seed: IESAEILQAVPSGEGDAFEL (PMEL_HUMAN)
  Core: AEILQAVPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IESXEIXQXVPXGEGDAFEL

SEQ ID NO: 329077 - protein, 20 aa, Artificial Sequence
  Description of Artificial Sequence: Synthetic peptide
  Seed: IESAEILQAVPSGEGDAFEL (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFEL

SEQ ID NO: 329078 - protein, 20 aa, Artificial Sequence
  Description of Artificial Sequence: Synthetic peptide
  Seed: IESAEILQAVPSGEGDAFEL (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFEL

SEQ ID NO: 329079 - protein, 21 aa, Artificial Sequence
  Description of Artificial Sequence: Synthetic peptide
  Seed: IESAEILQAVPSGEGDAFELT (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFELT

SEQ ID NO: 329080 - protein, 21 aa, Artificial Sequence
  Description of Artificial Sequence: Synthetic peptide
  Seed: IESAEILQAVPSGEGDAFELT (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFELT

SEQ ID NO: 329081 - protein, 22 aa, Artificial Sequence
  Description of Artificial Sequence: Synthetic peptide
  Seed: IESAEILQAVPSGEGDAFELTV (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFELTV

SEQ ID NO: 329082 - protein, 22 aa, Artificial Sequence
  Description of Artificial Sequence: Synthetic peptide
  Seed: IESAEILQAVPSGEGDAFELTV (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFELTV

SEQ ID NO: 329083 - protein, 23 aa, Artificial Sequence
  Description of Artificial Sequence: Synthetic peptide
  Seed: IESAEILQAVPSGEGDAFELTVS (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFELTVS

SEQ ID NO: 329084 - protein, 23 aa, Artificial Sequence
  Description of Artificial Sequence: Synthetic peptide
  Seed: IESAEILQAVPSGEGDAFELTVS (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFELTVS

SEQ ID NO: 329085 - protein, 23 aa, Artificial Sequence
  Description of Artificial Sequence: Synthetic peptide
  Seed: IESAEILQAVPSGEGDAFELTVS (PMEL_HUMAN)
  Core: GEGDAFELT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IESAEILQAVPSXEGXAXELXVS

SEQ ID NO: 329086 - protein, 24 aa, Artificial Sequence
  Description of Artificial Sequence: Synthetic peptide
  Seed: IESAEILQAVPSGEGDAFELTVSC (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFELTVSC

SEQ ID NO: 329087 - protein, 24 aa, Artificial Sequence
  Description of Artificial Sequence: Synthetic peptide
  Seed: IESAEILQAVPSGEGDAFELTVSC (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFELTVSC

SEQ ID NO: 329088 - protein, 25 aa, Artificial Sequence
  Description of Artificial Sequence: Synthetic peptide
  Seed: IESAEILQAVPSGEGDAFELTVSCQ (PMEL_HUMAN)
  Core: ILQAVPSGE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IESAEXLQXVXSGXGDAFELTVSCQ

SEQ ID NO: 329089 - protein, 25 aa, Artificial Sequence
  Description of Artificial Sequence: Synthetic peptide
  Seed: IESAEILQAVPSGEGDAFELTVSCQ (PMEL_HUMAN)
  Core: LQAVPSGEG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IESAEIXQAXPXGEXDAFELTVSCQ

SEQ ID NO: 329090 - protein, 25 aa, Artificial Sequence
  Description of Artificial Sequence: Synthetic peptide
  Seed: IESAEILQAVPSGEGDAFELTVSCQ (PMEL_HUMAN)
  Core: GEGDAFELT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IESAEILQAVPSXEGXAXELXVSCQ

SEQ ID NO: 329091 - protein, 23 aa, Artificial Sequence
  Description of Artificial Sequence: Synthetic peptide
  Seed: IFPDGGPCPSGSWSQKRSFVYVW (PMEL_HUMAN)
  Core: WSQKRSFVY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFPDGGPCPSGSXSQXRXFVXVW

SEQ ID NO: 329092 - protein, 24 aa, Artificial Sequence
  Description of Artificial Sequence: Synthetic peptide
  Seed: IFPDGGPCPSGSWSQKRSFVYVWK (PMEL_HUMAN)
  Core: WSQKRSFVY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFPDGGPCPSGSXSQXRXFVXVWK

SEQ ID NO: 329093 - protein, 25 aa, Artificial Sequence
  Description of Artificial Sequence: Synthetic peptide
  Seed: IFPDGGPCPSGSWSQKRSFVYVWKT (PMEL_HUMAN)
  Core: WSQKRSFVY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IFPDGGPCPSGSXSQXRXFVXVWKT

SEQ ID NO: 329094 - protein, 13 aa, Artificial Sequence
  Description of Artificial Sequence: Synthetic peptide
  Seed: IGALLAVGATKVP (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXP

SEQ ID NO: 329095 - protein, 14 aa, Artificial Sequence
  Description of Artificial Sequence: Synthetic peptide
  Seed: IGALLAVGATKVPR (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPR

SEQ ID NO: 329096 - protein, 15 aa, Artificial Sequence
  Description of Artificial Sequence: Synthetic peptide
  Seed: IGALLAVGATKVPRN (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRN

SEQ ID NO: 329097 - protein, 16 aa, Artificial Sequence
  Description of Artificial Sequence: Synthetic peptide
  Seed: IGALLAVGATKVPRNQ (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQ

SEQ ID NO: 329098 - protein, 16 aa, Artificial Sequence
  Description of Artificial Sequence: Synthetic peptide
  Seed: IGALLAVGATKVPRNQ (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQ

SEQ ID NO: 329099 - protein, 17 aa, Artificial Sequence
  Description of Artificial Sequence: Synthetic peptide
  Seed: IGALLAVGATKVPRNQD (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQD

SEQ ID NO: 329100 - protein, 17 aa, Artificial Sequence
  Description of Artificial Sequence: Synthetic peptide
  Seed: IGALLAVGATKVPRNQD (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQD

SEQ ID NO: 329101 - protein, 17 aa, Artificial Sequence
  Description of Artificial Sequence: Synthetic peptide
  Seed: IGALLAVGATKVPRNQD (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQD

SEQ ID NO: 329102 - protein, 18 aa, Artificial Sequence
  Description of Artificial Sequence: Synthetic peptide
  Seed: IGALLAVGATKVPRNQDW (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDW

SEQ ID NO: 329103 - protein, 18 aa, Artificial Sequence
  Description of Artificial Sequence: Synthetic peptide
  Seed: IGALLAVGATKVPRNQDW (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDW

SEQ ID NO: 329104 - protein, 19 aa, Artificial Sequence
  Description of Artificial Sequence: Synthetic peptide
  Seed: IGALLAVGATKVPRNQDWL (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWL

SEQ ID NO: 329105 - protein, 19 aa, Artificial Sequence
  Description of Artificial Sequence: Synthetic peptide
  Seed: IGALLAVGATKVPRNQDWL (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWL

SEQ ID NO: 329106 - protein, 19 aa, Artificial Sequence
  Description of Artificial Sequence: Synthetic peptide
  Seed: IGALLAVGATKVPRNQDWL (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWL

SEQ ID NO: 329107 - protein, 20 aa, Artificial Sequence
  Description of Artificial Sequence: Synthetic peptide
  Seed: IGALLAVGATKVPRNQDWLG (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWLG

SEQ ID NO: 329108 - protein, 20 aa, Artificial Sequence
  Description of Artificial Sequence: Synthetic peptide
  Seed: IGALLAVGATKVPRNQDWLG (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWLG

SEQ ID NO: 329109 - protein, 20 aa, Artificial Sequence
  Description of Artificial Sequence: Synthetic peptide
  Seed: IGALLAVGATKVPRNQDWLG (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWLG

SEQ ID NO: 329110 - protein, 20 aa, Artificial Sequence
  Description of Artificial Sequence: Synthetic peptide
  Seed: IGALLAVGATKVPRNQDWLG (PMEL_HUMAN)
  Core: ATKVPRNQD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAVGXTKXPXNQXWLG

SEQ ID NO: 329111 - protein, 21 aa, Artificial Sequence
  Description of Artificial Sequence: Synthetic peptide
  Seed: IGALLAVGATKVPRNQDWLGV (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWLGV

SEQ ID NO: 329112 - protein, 21 aa, Artificial Sequence
  Description of Artificial Sequence: Synthetic peptide
  Seed: IGALLAVGATKVPRNQDWLGV (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWLGV

SEQ ID NO: 329113 - protein, 21 aa, Artificial Sequence
  Description of Artificial Sequence: Synthetic peptide
  Seed: IGALLAVGATKVPRNQDWLGV (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWLGV

SEQ ID NO: 329114 - protein, 22 aa, Artificial Sequence
  Description of Artificial Sequence: Synthetic peptide
  Seed: IGALLAVGATKVPRNQDWLGVS (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWLGVS

SEQ ID NO: 329115 - protein, 22 aa, Artificial Sequence
  Description of Artificial Sequence: Synthetic peptide
  Seed: IGALLAVGATKVPRNQDWLGVS (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWLGVS

SEQ ID NO: 329116 - protein, 22 aa, Artificial Sequence
  Description of Artificial Sequence: Synthetic peptide
  Seed: IGALLAVGATKVPRNQDWLGVS (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWLGVS

SEQ ID NO: 329117 - protein, 23 aa, Artificial Sequence
  Description of Artificial Sequence: Synthetic peptide
  Seed: IGALLAVGATKVPRNQDWLGVSR (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWLGVSR

SEQ ID NO: 329118 - protein, 23 aa, Artificial Sequence
  Description of Artificial Sequence: Synthetic peptide
  Seed: IGALLAVGATKVPRNQDWLGVSR (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWLGVSR

SEQ ID NO: 329119 - protein, 23 aa, Artificial Sequence
  Description of Artificial Sequence: Synthetic peptide
  Seed: IGALLAVGATKVPRNQDWLGVSR (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWLGVSR

SEQ ID NO: 329120 - protein, 24 aa, Artificial Sequence
  Description of Artificial Sequence: Synthetic peptide
  Seed: IGALLAVGATKVPRNQDWLGVSRQ (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWLGVSRQ

SEQ ID NO: 329121 - protein, 24 aa, Artificial Sequence
  Description of Artificial Sequence: Synthetic peptide
  Seed: IGALLAVGATKVPRNQDWLGVSRQ (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWLGVSRQ

SEQ ID NO: 329122 - protein, 24 aa, Artificial Sequence
  Description of Artificial Sequence: Synthetic peptide
  Seed: IGALLAVGATKVPRNQDWLGVSRQ (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWLGVSRQ

SEQ ID NO: 329123 - protein, 24 aa, Artificial Sequence
  Description of Artificial Sequence: Synthetic peptide
  Seed: IGALLAVGATKVPRNQDWLGVSRQ (PMEL_HUMAN)
  Core: RNQDWLGVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAVGATKVPXNQXWXGVXRQ

SEQ ID NO: 329124 - protein, 25 aa, Artificial Sequence
  Description of Artificial Sequence: Synthetic peptide
  Seed: IGALLAVGATKVPRNQDWLGVSRQL (PMEL_HUMAN)
  Core: LLAVGATKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXLAXGXTKXPRNQDWLGVSRQL

SEQ ID NO: 329125 - protein, 25 aa, Artificial Sequence
  Description of Artificial Sequence: Synthetic peptide
  Seed: IGALLAVGATKVPRNQDWLGVSRQL (PMEL_HUMAN)
  Core: AVGATKVPR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IGALLXVGXTXVPXNQDWLGVSRQL

SEQ ID NO: 329126 - protein, 25 aa, Artificial Sequence
  Description of Artificial Sequence: Synthetic peptide
  Seed: IGALLAVGATKVPRNQDWLGVSRQL (PMEL_HUMAN)
  Core: VGATKVPRN
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAXGAXKXPRXQDWLGVSRQL

SEQ ID NO: 329127 - protein, 25 aa, Artificial Sequence
  Description of Artificial Sequence: Synthetic peptide
  Seed: IGALLAVGATKVPRNQDWLGVSRQL (PMEL_HUMAN)
  Core: RNQDWLGVS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IGALLAVGATKVPXNQXWXGVXRQL

SEQ ID NO: 329128 - protein, 13 aa, Artificial Sequence
  Description of Artificial Sequence: Synthetic peptide
  Seed: IGANASFSIALNF (PMEL_HUMAN)
  Core: ANASFSIAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IGXNAXFXIAXNF

SEQ ID NO: 329129 - protein, 13 aa, Artificial Sequence
  Description of Artificial Sequence: Synthetic peptide
  Seed: IGANASFSIALNF (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXF

SEQ ID NO: 329130 - protein, 14 aa, Artificial Sequence
  Description of Artificial Sequence: Synthetic peptide
  Seed: IGANASFSIALNFP (PMEL_HUMAN)
  Core: ANASFSIAL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IGXNAXFXIAXNFP

SEQ ID NO: 329131 - protein, 14 aa, Artificial Sequence
  Description of Artificial Sequence: Synthetic peptide
  Seed: IGANASFSIALNFP (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFP

SEQ ID NO: 329132 - protein, 14 aa, Artificial Sequence
  Description of Artificial Sequence: Synthetic peptide
  Seed: IGANASFSIALNFP (PMEL_HUMAN)
  Core: ASFSIALNF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGANXSFXIXLNXP

SEQ ID NO: 329133 - protein, 15 aa, Artificial Sequence
  Description of Artificial Sequence: Synthetic peptide
  Seed: IGANASFSIALNFPG (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPG

SEQ ID NO: 329134 - protein, 15 aa, Artificial Sequence
  Description of Artificial Sequence: Synthetic peptide
  Seed: IGANASFSIALNFPG (PMEL_HUMAN)
  Core: ASFSIALNF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGANXSFXIXLNXPG

SEQ ID NO: 329135 - protein, 15 aa, Artificial Sequence
  Description of Artificial Sequence: Synthetic peptide
  Seed: IGANASFSIALNFPG (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPX

SEQ ID NO: 329136 - protein, 16 aa, Artificial Sequence
  Description of Artificial Sequence: Synthetic peptide
  Seed: IGANASFSIALNFPGS (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGS

SEQ ID NO: 329137 - protein, 16 aa, Artificial Sequence
  Description of Artificial Sequence: Synthetic peptide
  Seed: IGANASFSIALNFPGS (PMEL_HUMAN)
  Core: ASFSIALNF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGANXSFXIXLNXPGS

SEQ ID NO: 329138 - protein, 16 aa, Artificial Sequence
  Description of Artificial Sequence: Synthetic peptide
  Seed: IGANASFSIALNFPGS (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXS

SEQ ID NO: 329139 - protein, 17 aa, Artificial Sequence
  Description of Artificial Sequence: Synthetic peptide
  Seed: IGANASFSIALNFPGSQ (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQ

SEQ ID NO: 329140 - protein, 17 aa, Artificial Sequence
  Description of Artificial Sequence: Synthetic peptide
  Seed: IGANASFSIALNFPGSQ (PMEL_HUMAN)
  Core: ASFSIALNF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGANXSFXIXLNXPGSQ

SEQ ID NO: 329141 - protein, 17 aa, Artificial Sequence
  Description of Artificial Sequence: Synthetic peptide
  Seed: IGANASFSIALNFPGSQ (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQ

SEQ ID NO: 329142 - protein, 18 aa, Artificial Sequence
  Description of Artificial Sequence: Synthetic peptide
  Seed: IGANASFSIALNFPGSQK (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQK

SEQ ID NO: 329143 - protein, 18 aa, Artificial Sequence
  Description of Artificial Sequence: Synthetic peptide
  Seed: IGANASFSIALNFPGSQK (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQK

SEQ ID NO: 329144 - protein, 19 aa, Artificial Sequence
  Description of Artificial Sequence: Synthetic peptide
  Seed: IGANASFSIALNFPGSQKV (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKV

SEQ ID NO: 329145 - protein, 19 aa, Artificial Sequence
  Description of Artificial Sequence: Synthetic peptide
  Seed: IGANASFSIALNFPGSQKV (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKV

SEQ ID NO: 329146 - protein, 20 aa, Artificial Sequence
  Description of Artificial Sequence: Synthetic peptide
  Seed: IGANASFSIALNFPGSQKVL (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKVL

SEQ ID NO: 329147 - protein, 20 aa, Artificial Sequence
  Description of Artificial Sequence: Synthetic peptide
  Seed: IGANASFSIALNFPGSQKVL (PMEL_HUMAN)
  Core: ASFSIALNF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGANXSFXIXLNXPGSQKVL

SEQ ID NO: 329148 - protein, 20 aa, Artificial Sequence
  Description of Artificial Sequence: Synthetic peptide
  Seed: IGANASFSIALNFPGSQKVL (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKVL

SEQ ID NO: 329149 - protein, 21 aa, Artificial Sequence
  Description of Artificial Sequence: Synthetic peptide
  Seed: IGANASFSIALNFPGSQKVLP (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKVLP

SEQ ID NO: 329150 - protein, 21 aa, Artificial Sequence
  Description of Artificial Sequence: Synthetic peptide
  Seed: IGANASFSIALNFPGSQKVLP (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKVLP

SEQ ID NO: 329151 - protein, 22 aa, Artificial Sequence
  Description of Artificial Sequence: Synthetic peptide
  Seed: IGANASFSIALNFPGSQKVLPD (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKVLPD

SEQ ID NO: 329152 - protein, 22 aa, Artificial Sequence
  Description of Artificial Sequence: Synthetic peptide
  Seed: IGANASFSIALNFPGSQKVLPD (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKVLPD

SEQ ID NO: 329153 - protein, 22 aa, Artificial Sequence
  Description of Artificial Sequence: Synthetic peptide
  Seed: IGANASFSIALNFPGSQKVLPD (PMEL_HUMAN)
  Core: LNFPGSQKV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IGANASFSIAXNFXGXQKXLPD

SEQ ID NO: 329154 - protein, 23 aa, Artificial Sequence
  Description of Artificial Sequence: Synthetic peptide
  Seed: IGANASFSIALNFPGSQKVLPDG (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKVLPDG

SEQ ID NO: 329155 - protein, 23 aa, Artificial Sequence
  Description of Artificial Sequence: Synthetic peptide
  Seed: IGANASFSIALNFPGSQKVLPDG (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKVLPDG

SEQ ID NO: 329156 - protein, 23 aa, Artificial Sequence
  Description of Artificial Sequence: Synthetic peptide
  Seed: IGANASFSIALNFPGSQKVLPDG (PMEL_HUMAN)
  Core: LNFPGSQKV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IGANASFSIAXNFXGXQKXLPDG

SEQ ID NO: 329157 - protein, 24 aa, Artificial Sequence
  Description of Artificial Sequence: Synthetic peptide
  Seed: IGANASFSIALNFPGSQKVLPDGQ (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKVLPDGQ

SEQ ID NO: 329158 - protein, 24 aa, Artificial Sequence
  Description of Artificial Sequence: Synthetic peptide
  Seed: IGANASFSIALNFPGSQKVLPDGQ (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKVLPDGQ

SEQ ID NO: 329159 - protein, 24 aa, Artificial Sequence
  Description of Artificial Sequence: Synthetic peptide
  Seed: IGANASFSIALNFPGSQKVLPDGQ (PMEL_HUMAN)
  Core: LNFPGSQKV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IGANASFSIAXNFXGXQKXLPDGQ

SEQ ID NO: 329160 - protein, 24 aa, Artificial Sequence
  Description of Artificial Sequence: Synthetic peptide
  Seed: IGANASFSIALNFPGSQKVLPDGQ (PMEL_HUMAN)
  Core: PGSQKVLPD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IGANASFSIALNFXGSXKXLPXGQ

SEQ ID NO: 329161 - protein, 25 aa, Artificial Sequence
  Description of Artificial Sequence: Synthetic peptide
  Seed: IGANASFSIALNFPGSQKVLPDGQV (PMEL_HUMAN)
  Core: NASFSIALN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGAXASXSXALXFPGSQKVLPDGQV

SEQ ID NO: 329162 - protein, 25 aa, Artificial Sequence
  Description of Artificial Sequence: Synthetic peptide
  Seed: IGANASFSIALNFPGSQKVLPDGQV (PMEL_HUMAN)
  Core: FSIALNFPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGANASXSIXLXFPXSQKVLPDGQV

SEQ ID NO: 329163 - protein, 25 aa, Artificial Sequence
  Description of Artificial Sequence: Synthetic peptide
  Seed: IGANASFSIALNFPGSQKVLPDGQV (PMEL_HUMAN)
  Core: LNFPGSQKV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IGANASFSIAXNFXGXQKXLPDGQV

SEQ ID NO: 329164 - protein, 25 aa, Artificial Sequence
  Description of Artificial Sequence: Synthetic peptide
  Seed: IGANASFSIALNFPGSQKVLPDGQV (PMEL_HUMAN)
  Core: PGSQKVLPD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IGANASFSIALNFXGSXKXLPXGQV

SEQ ID NO: 329165 - protein, 13 aa, Artificial Sequence
  Description of Artificial Sequence: Synthetic peptide
  Seed: IGTGRAMLGTHTM (PMEL_HUMAN)
  Core: IGTGRAMLG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XGTXRXMLXTHTM

SEQ ID NO: 329166 - protein, 14 aa, Artificial Sequence
  Description of Artificial Sequence: Synthetic peptide
  Seed: IGTGRAMLGTHTME (PMEL_HUMAN)
  Core: IGTGRAMLG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XGTXRXMLXTHTME

SEQ ID NO: 329167 - protein, 15 aa, Artificial Sequence
  Description of Artificial Sequence: Synthetic peptide
  Seed: IGTGRAMLGTHTMEV (PMEL_HUMAN)
  Core: IGTGRAMLG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XGTXRXMLXTHTMEV

SEQ ID NO: 329168 - protein, 15 aa, Artificial Sequence
  Description of Artificial Sequence: Synthetic peptide
  Seed: IGTGRAMLGTHTMEV (PMEL_HUMAN)
  Core: GRAMLGTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGTXRAXLXTHXMEV

SEQ ID NO: 329169 - protein, 15 aa, Artificial Sequence
  Description of Artificial Sequence: Synthetic peptide
  Seed: IGTGRAMLGTHTMEV (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEV

SEQ ID NO: 329170 - protein, 15 aa, Artificial Sequence
  Description of Artificial Sequence: Synthetic peptide
  Seed: IGTGRAMLGTHTMEV (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEX

SEQ ID NO: 329171 - protein, 16 aa, Artificial Sequence
  Description of Artificial Sequence: Synthetic peptide
  Seed: IGTGRAMLGTHTMEVT (PMEL_HUMAN)
  Core: GRAMLGTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGTXRAXLXTHXMEVT

SEQ ID NO: 329172 - protein, 16 aa, Artificial Sequence
  Description of Artificial Sequence: Synthetic peptide
  Seed: IGTGRAMLGTHTMEVT (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVT

SEQ ID NO: 329173 - protein, 16 aa, Artificial Sequence
  Description of Artificial Sequence: Synthetic peptide
  Seed: IGTGRAMLGTHTMEVT (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXT

SEQ ID NO: 329174 - protein, 17 aa, Artificial Sequence
  Description of Artificial Sequence: Synthetic peptide
  Seed: IGTGRAMLGTHTMEVTV (PMEL_HUMAN)
  Core: GRAMLGTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IGTXRAXLXTHXMEVTV

SEQ ID NO: 329175 - protein, 17 aa, Artificial Sequence
  Description of Artificial Sequence: Synthetic peptide
  Seed: IGTGRAMLGTHTMEVTV (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTV

SEQ ID NO: 329176 - protein, 17 aa, Artificial Sequence
  Description of Artificial Sequence: Synthetic peptide
  Seed: IGTGRAMLGTHTMEVTV (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTV

SEQ ID NO: 329177 - protein, 18 aa, Artificial Sequence
  Description of Artificial Sequence: Synthetic peptide
  Seed: IGTGRAMLGTHTMEVTVY (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVY

SEQ ID NO: 329178 - protein, 19 aa, Artificial Sequence
  Description of Artificial Sequence: Synthetic peptide
  Seed: IGTGRAMLGTHTMEVTVYH (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTVYH

SEQ ID NO: 329179 - protein, 19 aa, Artificial Sequence
  Description of Artificial Sequence: Synthetic peptide
  Seed: IGTGRAMLGTHTMEVTVYH (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYH

SEQ ID NO: 329180 - protein, 19 aa, Artificial Sequence
  Description of Artificial Sequence: Synthetic peptide
  Seed: IGTGRAMLGTHTMEVTVYH (PMEL_HUMAN)
  Core: LGTHTMEVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMXGTXTXEVXVYH

SEQ ID NO: 329181 - protein, 19 aa, Artificial Sequence
  Description of Artificial Sequence: Synthetic peptide
  Seed: IGTGRAMLGTHTMEVTVYH (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXH

SEQ ID NO: 329182 - protein, 20 aa, Artificial Sequence
  Description of Artificial Sequence: Synthetic peptide
  Seed: IGTGRAMLGTHTMEVTVYHR (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTVYHR

SEQ ID NO: 329183 - protein, 20 aa, Artificial Sequence
  Description of Artificial Sequence: Synthetic peptide
  Seed: IGTGRAMLGTHTMEVTVYHR (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYHR

SEQ ID NO: 329184 - protein, 20 aa, Artificial Sequence
  Description of Artificial Sequence: Synthetic peptide
  Seed: IGTGRAMLGTHTMEVTVYHR (PMEL_HUMAN)
  Core: LGTHTMEVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMXGTXTXEVXVYHR

SEQ ID NO: 329185 - protein, 20 aa, Artificial Sequence
  Description of Artificial Sequence: Synthetic peptide
  Seed: IGTGRAMLGTHTMEVTVYHR (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXHR

SEQ ID NO: 329186 - protein, 21 aa, Artificial Sequence
  Description of Artificial Sequence: Synthetic peptide
  Seed: IGTGRAMLGTHTMEVTVYHRR (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTVYHRR

SEQ ID NO: 329187 - protein, 21 aa, Artificial Sequence
  Description of Artificial Sequence: Synthetic peptide
  Seed: IGTGRAMLGTHTMEVTVYHRR (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYHRR

SEQ ID NO: 329188 - protein, 21 aa, Artificial Sequence
  Description of Artificial Sequence: Synthetic peptide
  Seed: IGTGRAMLGTHTMEVTVYHRR (PMEL_HUMAN)
  Core: LGTHTMEVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMXGTXTXEVXVYHRR

SEQ ID NO: 329189 - protein, 21 aa, Artificial Sequence
  Description of Artificial Sequence: Synthetic peptide
  Seed: IGTGRAMLGTHTMEVTVYHRR (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXHRR

SEQ ID NO: 329190 - protein, 22 aa, Artificial Sequence
  Description of Artificial Sequence: Synthetic peptide
  Seed: IGTGRAMLGTHTMEVTVYHRRG (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTVYHRRG

SEQ ID NO: 329191 - protein, 22 aa, Artificial Sequence
  Description of Artificial Sequence: Synthetic peptide
  Seed: IGTGRAMLGTHTMEVTVYHRRG (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYHRRG

SEQ ID NO: 329192 - protein, 22 aa, Artificial Sequence
  Description of Artificial Sequence: Synthetic peptide
  Seed: IGTGRAMLGTHTMEVTVYHRRG (PMEL_HUMAN)
  Core: LGTHTMEVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMXGTXTXEVXVYHRRG

SEQ ID NO: 329193 - protein, 22 aa, Artificial Sequence
  Description of Artificial Sequence: Synthetic peptide
  Seed: IGTGRAMLGTHTMEVTVYHRRG (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXHRRG

SEQ ID NO: 329194 - protein, 22 aa, Artificial Sequence
  Description of Artificial Sequence: Synthetic peptide
  Seed: IGTGRAMLGTHTMEVTVYHRRG (PMEL_HUMAN)
  Core: MEVTVYHRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTXEVXVXHRXG

SEQ ID NO: 329195 - protein, 23 aa, Artificial Sequence
  Description of Artificial Sequence: Synthetic peptide
  Seed: IGTGRAMLGTHTMEVTVYHRRGS (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTVYHRRGS

SEQ ID NO: 329196 - protein, 23 aa, Artificial Sequence
  Description of Artificial Sequence: Synthetic peptide
  Seed: IGTGRAMLGTHTMEVTVYHRRGS (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYHRRGS

SEQ ID NO: 329197 - protein, 23 aa, Artificial Sequence
  Description of Artificial Sequence: Synthetic peptide
  Seed: IGTGRAMLGTHTMEVTVYHRRGS (PMEL_HUMAN)
  Core: LGTHTMEVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMXGTXTXEVXVYHRRGS

SEQ ID NO: 329198 - protein, 23 aa, Artificial Sequence
  Description of Artificial Sequence: Synthetic peptide
  Seed: IGTGRAMLGTHTMEVTVYHRRGS (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXHRRGS

SEQ ID NO: 329199 - protein, 23 aa, Artificial Sequence
  Description of Artificial Sequence: Synthetic peptide
  Seed: IGTGRAMLGTHTMEVTVYHRRGS (PMEL_HUMAN)
  Core: MEVTVYHRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTXEVXVXHRXGS

SEQ ID NO: 329200 - protein, 23 aa, Artificial Sequence
  Description of Artificial Sequence: Synthetic peptide
  Seed: IGTGRAMLGTHTMEVTVYHRRGS (PMEL_HUMAN)
  Core: VTVYHRRGS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTMEXTVXHXRGX

SEQ ID NO: 329201 - protein, 24 aa, Artificial Sequence
  Description of Artificial Sequence: Synthetic peptide
  Seed: IGTGRAMLGTHTMEVTVYHRRGSR (PMEL_HUMAN)
  Core: RAMLGTHTM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IGTGXAMXGXHTXEVTVYHRRGSR

SEQ ID NO: 329202 - protein, 24 aa, Artificial Sequence
  Description of Artificial Sequence: Synthetic peptide
  Seed: IGTGRAMLGTHTMEVTVYHRRGSR (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYHRRGSR

SEQ ID NO: 329203 - protein, 24 aa, Artificial Sequence
  Description of Artificial Sequence: Synthetic peptide
  Seed: IGTGRAMLGTHTMEVTVYHRRGSR (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXHRRGSR

SEQ ID NO: 329204 - protein, 24 aa, Artificial Sequence
  Description of Artificial Sequence: Synthetic peptide
  Seed: IGTGRAMLGTHTMEVTVYHRRGSR (PMEL_HUMAN)
  Core: MEVTVYHRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTXEVXVXHRXGSR

SEQ ID NO: 329205 - protein, 24 aa, Artificial Sequence
  Description of Artificial Sequence: Synthetic peptide
  Seed: IGTGRAMLGTHTMEVTVYHRRGSR (PMEL_HUMAN)
  Core: VTVYHRRGS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTMEXTVXHXRGXR

SEQ ID NO: 329206 - protein, 25 aa, Artificial Sequence
  Description of Artificial Sequence: Synthetic peptide
  Seed: IGTGRAMLGTHTMEVTVYHRRGSRS (PMEL_HUMAN)
  Core: MLGTHTMEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAXLGXHXMEXTVYHRRGSRS

SEQ ID NO: 329207 - protein, 25 aa, Artificial Sequence
  Description of Artificial Sequence: Synthetic peptide
  Seed: IGTGRAMLGTHTMEVTVYHRRGSRS (PMEL_HUMAN)
  Core: THTMEVTVY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGXHTXEXTVXHRRGSRS

SEQ ID NO: 329208 - protein, 25 aa, Artificial Sequence
  Description of Artificial Sequence: Synthetic peptide
  Seed: IGTGRAMLGTHTMEVTVYHRRGSRS (PMEL_HUMAN)
  Core: HTMEVTVYH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTXTMXVXVYXRRGSRS

SEQ ID NO: 329209 - protein, 25 aa, Artificial Sequence
  Description of Artificial Sequence: Synthetic peptide
  Seed: IGTGRAMLGTHTMEVTVYHRRGSRS (PMEL_HUMAN)
  Core: MEVTVYHRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTXEVXVXHRXGSRS

SEQ ID NO: 329210 - protein, 25 aa, Artificial Sequence
  Description of Artificial Sequence: Synthetic peptide
  Seed: IGTGRAMLGTHTMEVTVYHRRGSRS (PMEL_HUMAN)
  Core: EVTVYHRRG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTMXVTXYXRRXSRS

SEQ ID NO: 329211 - protein, 25 aa, Artificial Sequence
  Description of Artificial Sequence: Synthetic peptide
  Seed: IGTGRAMLGTHTMEVTVYHRRGSRS (PMEL_HUMAN)
  Core: VTVYHRRGS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IGTGRAMLGTHTMEXTVXHXRGXRS

SEQ ID NO: 329212 - protein, 13 aa, Artificial Sequence
  Description of Artificial Sequence: Synthetic peptide
  Seed: IINGSQVWGGQPV (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPV

SEQ ID NO: 329213 - protein, 14 aa, Artificial Sequence
  Description of Artificial Sequence: Synthetic peptide
  Seed: IINGSQVWGGQPVY (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVY

SEQ ID NO: 329214 - protein, 15 aa, Artificial Sequence
  Description of Artificial Sequence: Synthetic peptide
  Seed: IINGSQVWGGQPVYP (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYP

SEQ ID NO: 329215 - protein, 15 aa, Artificial Sequence
  Description of Artificial Sequence: Synthetic peptide
  Seed: IINGSQVWGGQPVYP (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYX

SEQ ID NO: 329216 - protein, 16 aa, Artificial Sequence
  Description of Artificial Sequence: Synthetic peptide
  Seed: IINGSQVWGGQPVYPQ (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQ

SEQ ID NO: 329217 - protein, 16 aa, Artificial Sequence
  Description of Artificial Sequence: Synthetic peptide
  Seed: IINGSQVWGGQPVYPQ (PMEL_HUMAN)
  Core: SQVWGGQPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IINGXQVXGXQPXYPQ

SEQ ID NO: 329218 - protein, 16 aa, Artificial Sequence
  Description of Artificial Sequence: Synthetic peptide
  Seed: IINGSQVWGGQPVYPQ (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQ

SEQ ID NO: 329219 - protein, 17 aa, Artificial Sequence
  Description of Artificial Sequence: Synthetic peptide
  Seed: IINGSQVWGGQPVYPQE (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQE

SEQ ID NO: 329220 - protein, 17 aa, Artificial Sequence
  Description of Artificial Sequence: Synthetic peptide
  Seed: IINGSQVWGGQPVYPQE (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQE

SEQ ID NO: 329221 - protein, 18 aa, Artificial Sequence
  Description of Artificial Sequence: Synthetic peptide
  Seed: IINGSQVWGGQPVYPQET (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQET

SEQ ID NO: 329222 - protein, 18 aa, Artificial Sequence
  Description of Artificial Sequence: Synthetic peptide
  Seed: IINGSQVWGGQPVYPQET (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQET

SEQ ID NO: 329223 - protein, 19 aa, Artificial Sequence
  Description of Artificial Sequence: Synthetic peptide
  Seed: IINGSQVWGGQPVYPQETD (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETD

SEQ ID NO: 329224 - protein, 19 aa, Artificial Sequence
  Description of Artificial Sequence: Synthetic peptide
  Seed: IINGSQVWGGQPVYPQETD (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETD

SEQ ID NO: 329225 - protein, 20 aa, Artificial Sequence
  Description of Artificial Sequence: Synthetic peptide
  Seed: IINGSQVWGGQPVYPQETDD (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETDD

SEQ ID NO: 329226 - protein, 20 aa, Artificial Sequence
  Description of Artificial Sequence: Synthetic peptide
  Seed: IINGSQVWGGQPVYPQETDD (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETDD

SEQ ID NO: 329227 - protein, 20 aa, Artificial Sequence
  Description of Artificial Sequence: Synthetic peptide
  Seed: IINGSQVWGGQPVYPQETDD (PMEL_HUMAN)
  Core: WGGQPVYPQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQVXGGXPXYPXETDD

SEQ ID NO: 329228 - protein, 21 aa, Artificial Sequence
  Description of Artificial Sequence: Synthetic peptide
  Seed: IINGSQVWGGQPVYPQETDDA (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETDDA

SEQ ID NO: 329229 - protein, 21 aa, Artificial Sequence
  Description of Artificial Sequence: Synthetic peptide
  Seed: IINGSQVWGGQPVYPQETDDA (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETDDA

SEQ ID NO: 329230 - protein, 22 aa, Artificial Sequence
  Description of Artificial Sequence: Synthetic peptide
  Seed: IINGSQVWGGQPVYPQETDDAC (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETDDAC

SEQ ID NO: 329231 - protein, 22 aa, Artificial Sequence
  Description of Artificial Sequence: Synthetic peptide
  Seed: IINGSQVWGGQPVYPQETDDAC (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETDDAC

SEQ ID NO: 329232 - protein, 23 aa, Artificial Sequence
  Description of Artificial Sequence: Synthetic peptide
  Seed: IINGSQVWGGQPVYPQETDDACI (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETDDACI

SEQ ID NO: 329233 - protein, 23 aa, Artificial Sequence
  Description of Artificial Sequence: Synthetic peptide
  Seed: IINGSQVWGGQPVYPQETDDACI (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETDDACI

SEQ ID NO: 329234 - protein, 24 aa, Artificial Sequence
  Description of Artificial Sequence: Synthetic peptide
  Seed: IINGSQVWGGQPVYPQETDDACIF (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETDDACIF

SEQ ID NO: 329235 - protein, 24 aa, Artificial Sequence
  Description of Artificial Sequence: Synthetic peptide
  Seed: IINGSQVWGGQPVYPQETDDACIF (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETDDACIF

SEQ ID NO: 329236 - protein, 25 aa, Artificial Sequence
  Description of Artificial Sequence: Synthetic peptide
  Seed: IINGSQVWGGQPVYPQETDDACIFP (PMEL_HUMAN)
  Core: INGSQVWGG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXNGXQXWGXQPVYPQETDDACIFP

SEQ ID NO: 329237 - protein, 25 aa, Artificial Sequence
  Description of Artificial Sequence: Synthetic peptide
  Seed: IINGSQVWGGQPVYPQETDDACIFP (PMEL_HUMAN)
  Core: VWGGQPVYP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IINGSQXWGXQXVYXQETDDACIFP

SEQ ID NO: 329238 - protein, 14 aa, Artificial Sequence
  Description of Artificial Sequence: Synthetic peptide
  Seed: ILKGGSGTYCLNVS (PMEL_HUMAN)
  Core: LKGGSGTYC
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXKGXSXTYXLNVS

SEQ ID NO: 329239 - protein, 15 aa, Artificial Sequence
  Description of Artificial Sequence: Synthetic peptide
  Seed: ILKGGSGTYCLNVSL (PMEL_HUMAN)
  Core: LKGGSGTYC
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXKGXSXTYXLNVSL

SEQ ID NO: 329240 - protein, 16 aa, Artificial Sequence
  Description of Artificial Sequence: Synthetic peptide
  Seed: ILKGGSGTYCLNVSLA (PMEL_HUMAN)
  Core: LKGGSGTYC
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXKGXSXTYXLNVSLA

SEQ ID NO: 329241 - protein, 17 aa, Artificial Sequence
  Description of Artificial Sequence: Synthetic peptide
  Seed: ILKGGSGTYCLNVSLAD (PMEL_HUMAN)
  Core: TYCLNVSLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGXYCXNXSLXD

SEQ ID NO: 329242 - protein, 19 aa, Artificial Sequence
  Description of Artificial Sequence: Synthetic peptide
  Seed: ILKGGSGTYCLNVSLADTN (PMEL_HUMAN)
  Core: SGTYCLNVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGXGTXCXNVXLADTN

SEQ ID NO: 329243 - protein, 19 aa, Artificial Sequence
  Description of Artificial Sequence: Synthetic peptide
  Seed: ILKGGSGTYCLNVSLADTN (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTN

SEQ ID NO: 329244 - protein, 20 aa, Artificial Sequence
  Description of Artificial Sequence: Synthetic peptide
  Seed: ILKGGSGTYCLNVSLADTNS (PMEL_HUMAN)
  Core: TYCLNVSLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGXYCXNXSLXDTNS

SEQ ID NO: 329245 - protein, 20 aa, Artificial Sequence
  Description of Artificial Sequence: Synthetic peptide
  Seed: ILKGGSGTYCLNVSLADTNS (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTNS

SEQ ID NO: 329246 - protein, 21 aa, Artificial Sequence
  Description of Artificial Sequence: Synthetic peptide
  Seed: ILKGGSGTYCLNVSLADTNSL (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTNSL

SEQ ID NO: 329247 - protein, 22 aa, Artificial Sequence
  Description of Artificial Sequence: Synthetic peptide
  Seed: ILKGGSGTYCLNVSLADTNSLA (PMEL_HUMAN)
  Core: TYCLNVSLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGXYCXNXSLXDTNSLA

SEQ ID NO: 329248 - protein, 22 aa, Artificial Sequence
  Description of Artificial Sequence: Synthetic peptide
  Seed: ILKGGSGTYCLNVSLADTNSLA (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTNSLA

SEQ ID NO: 329249 - protein, 23 aa, Artificial Sequence
  Description of Artificial Sequence: Synthetic peptide
  Seed: ILKGGSGTYCLNVSLADTNSLAV (PMEL_HUMAN)
  Core: TYCLNVSLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGXYCXNXSLXDTNSLAV

SEQ ID NO: 329250 - protein, 23 aa, Artificial Sequence
  Description of Artificial Sequence: Synthetic peptide
  Seed: ILKGGSGTYCLNVSLADTNSLAV (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTNSLAV

SEQ ID NO: 329251 - protein, 23 aa, Artificial Sequence
  Description of Artificial Sequence: Synthetic peptide
  Seed: ILKGGSGTYCLNVSLADTNSLAV (PMEL_HUMAN)
  Core: NVSLADTNS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTYCLXVSXAXTNXLAV

SEQ ID NO: 329252 - protein, 23 aa, Artificial Sequence
  Description of Artificial Sequence: Synthetic peptide
  Seed: ILKGGSGTYCLNVSLADTNSLAV (PMEL_HUMAN)
  Core: VSLADTNSL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTYCLNXSLXDXNSXAV

SEQ ID NO: 329253 - protein, 23 aa, Artificial Sequence
  Description of Artificial Sequence: Synthetic peptide
  Seed: ILKGGSGTYCLNVSLADTNSLAV (PMEL_HUMAN)
  Core: LADTNSLAV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTYCLNVSXADXNXLAX

SEQ ID NO: 329254 - protein, 24 aa, Artificial Sequence
  Description of Artificial Sequence: Synthetic peptide
  Seed: ILKGGSGTYCLNVSLADTNSLAVV (PMEL_HUMAN)
  Core: TYCLNVSLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGXYCXNXSLXDTNSLAVV

SEQ ID NO: 329255 - protein, 24 aa, Artificial Sequence
  Description of Artificial Sequence: Synthetic peptide
  Seed: ILKGGSGTYCLNVSLADTNSLAVV (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTNSLAVV

SEQ ID NO: 329256 - protein, 24 aa, Artificial Sequence
  Description of Artificial Sequence: Synthetic peptide
  Seed: ILKGGSGTYCLNVSLADTNSLAVV (PMEL_HUMAN)
  Core: LADTNSLAV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTYCLNVSXADXNXLAXV

SEQ ID NO: 329257 - protein, 25 aa, Artificial Sequence
  Description of Artificial Sequence: Synthetic peptide
  Seed: ILKGGSGTYCLNVSLADTNSLAVVS (PMEL_HUMAN)
  Core: TYCLNVSLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGXYCXNXSLXDTNSLAVVS

SEQ ID NO: 329258 - protein, 25 aa, Artificial Sequence
  Description of Artificial Sequence: Synthetic peptide
  Seed: ILKGGSGTYCLNVSLADTNSLAVVS (PMEL_HUMAN)
  Core: YCLNVSLAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTXCLXVXLAXTNSLAVVS

SEQ ID NO: 329259 - protein, 25 aa, Artificial Sequence
  Description of Artificial Sequence: Synthetic peptide
  Seed: ILKGGSGTYCLNVSLADTNSLAVVS (PMEL_HUMAN)
  Core: LADTNSLAV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ILKGGSGTYCLNVSXADXNXLAXVS

SEQ ID NO: 329260 - protein, 14 aa, Artificial Sequence
  Description of Artificial Sequence: Synthetic peptide
  Seed: ILLVLMAVVLASLI (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLI

SEQ ID NO: 329261 - protein, 15 aa, Artificial Sequence
  Description of Artificial Sequence: Synthetic peptide
  Seed: ILLVLMAVVLASLIY (PMEL_HUMAN)
  Core: LLVLMAVVL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXLVXMXVVXASLIY

SEQ ID NO: 329262 - protein, 15 aa, Artificial Sequence
  Description of Artificial Sequence: Synthetic peptide
  Seed: ILLVLMAVVLASLIY (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIY

SEQ ID NO: 329263 - protein, 15 aa, Artificial Sequence
  Description of Artificial Sequence: Synthetic peptide
  Seed: ILLVLMAVVLASLIY (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIY

SEQ ID NO: 329264 - protein, 15 aa, Artificial Sequence
  Description of Artificial Sequence: Synthetic peptide
  Seed: ILLVLMAVVLASLIY (PMEL_HUMAN)
  Core: LMAVVLASL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILLVXMAXVXASXIY

SEQ ID NO: 329265 - protein, 16 aa, Artificial Sequence
  Description of Artificial Sequence: Synthetic peptide
  Seed: ILLVLMAVVLASLIYR (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYR

SEQ ID NO: 329266 - protein, 16 aa, Artificial Sequence
  Description of Artificial Sequence: Synthetic peptide
  Seed: ILLVLMAVVLASLIYR (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYR

SEQ ID NO: 329267 - protein, 16 aa, Artificial Sequence
  Description of Artificial Sequence: Synthetic peptide
  Seed: ILLVLMAVVLASLIYR (PMEL_HUMAN)
  Core: LMAVVLASL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILLVXMAXVXASXIYR

SEQ ID NO: 329268 - protein, 16 aa, Artificial Sequence
  Description of Artificial Sequence: Synthetic peptide
  Seed: ILLVLMAVVLASLIYR (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYR

SEQ ID NO: 329269 - protein, 17 aa, Artificial Sequence
  Description of Artificial Sequence: Synthetic peptide
  Seed: ILLVLMAVVLASLIYRR (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRR

SEQ ID NO: 329270 - protein, 17 aa, Artificial Sequence
  Description of Artificial Sequence: Synthetic peptide
  Seed: ILLVLMAVVLASLIYRR (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRR

SEQ ID NO: 329271 - protein, 17 aa, Artificial Sequence
  Description of Artificial Sequence: Synthetic peptide
  Seed: ILLVLMAVVLASLIYRR (PMEL_HUMAN)
  Core: LMAVVLASL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILLVXMAXVXASXIYRR

SEQ ID NO: 329272 - protein, 17 aa, Artificial Sequence
  Description of Artificial Sequence: Synthetic peptide
  Seed: ILLVLMAVVLASLIYRR (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRR

SEQ ID NO: 329273 - protein, 17 aa, Artificial Sequence
  Description of Artificial Sequence: Synthetic peptide
  Seed: ILLVLMAVVLASLIYRR (PMEL_HUMAN)
  Core: VVLASLIYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAXVLXSXIYXR

SEQ ID NO: 329274 - protein, 17 aa, Artificial Sequence
  Description of Artificial Sequence: Synthetic peptide
  Seed: ILLVLMAVVLASLIYRR (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRX

SEQ ID NO: 329275 - protein, 18 aa, Artificial Sequence
  Description of Artificial Sequence: Synthetic peptide
  Seed: ILLVLMAVVLASLIYRRR (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRR

SEQ ID NO: 329276 - protein, 18 aa, Artificial Sequence
  Description of Artificial Sequence: Synthetic peptide
  Seed: ILLVLMAVVLASLIYRRR (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRR

SEQ ID NO: 329277 - protein, 18 aa, Artificial Sequence
  Description of Artificial Sequence: Synthetic peptide
  Seed: ILLVLMAVVLASLIYRRR (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRR

SEQ ID NO: 329278 - protein, 18 aa, Artificial Sequence
  Description of Artificial Sequence: Synthetic peptide
  Seed: ILLVLMAVVLASLIYRRR (PMEL_HUMAN)
  Core: VVLASLIYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAXVLXSXIYXRR

SEQ ID NO: 329279 - protein, 18 aa, Artificial Sequence
  Description of Artificial Sequence: Synthetic peptide
  Seed: ILLVLMAVVLASLIYRRR (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXR

SEQ ID NO: 329280 - protein, 18 aa, Artificial Sequence
  Description of Artificial Sequence: Synthetic peptide
  Seed: ILLVLMAVVLASLIYRRR (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRX

SEQ ID NO: 329281 - protein, 19 aa, Artificial Sequence
  Description of Artificial Sequence: Synthetic peptide
  Seed: ILLVLMAVVLASLIYRRRL (PMEL_HUMAN)
  Core: LLVLMAVVL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXLVXMXVVXASLIYRRRL

SEQ ID NO: 329282 - protein, 19 aa, Artificial Sequence
  Description of Artificial Sequence: Synthetic peptide
  Seed: ILLVLMAVVLASLIYRRRL (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRRL

SEQ ID NO: 329283 - protein, 19 aa, Artificial Sequence
  Description of Artificial Sequence: Synthetic peptide
  Seed: ILLVLMAVVLASLIYRRRL (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRL

SEQ ID NO: 329284 - protein, 19 aa, Artificial Sequence
  Description of Artificial Sequence: Synthetic peptide
  Seed: ILLVLMAVVLASLIYRRRL (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRL

SEQ ID NO: 329285 - protein, 19 aa, Artificial Sequence
  Description of Artificial Sequence: Synthetic peptide
  Seed: ILLVLMAVVLASLIYRRRL (PMEL_HUMAN)
  Core: AVVLASLIY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMXVVXAXLIXRRRL

SEQ ID NO: 329286 - protein, 19 aa, Artificial Sequence
  Description of Artificial Sequence: Synthetic peptide
  Seed: ILLVLMAVVLASLIYRRRL (PMEL_HUMAN)
  Core: VVLASLIYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAXVLXSXIYXRRL

SEQ ID NO: 329287 - protein, 19 aa, Artificial Sequence
  Description of Artificial Sequence: Synthetic peptide
  Seed: ILLVLMAVVLASLIYRRRL (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRL

SEQ ID NO: 329288 - protein, 19 aa, Artificial Sequence
  Description of Artificial Sequence: Synthetic peptide
  Seed: ILLVLMAVVLASLIYRRRL (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXL

SEQ ID NO: 329289 - protein, 20 aa, Artificial Sequence
  Description of Artificial Sequence: Synthetic peptide
  Seed: ILLVLMAVVLASLIYRRRLM (PMEL_HUMAN)
  Core: LLVLMAVVL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXLVXMXVVXASLIYRRRLM

SEQ ID NO: 329290 - protein, 20 aa, Artificial Sequence
  Description of Artificial Sequence: Synthetic peptide
  Seed: ILLVLMAVVLASLIYRRRLM (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRRLM

SEQ ID NO: 329291 - protein, 20 aa, Artificial Sequence
  Description of Artificial Sequence: Synthetic peptide
  Seed: ILLVLMAVVLASLIYRRRLM (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRLM

SEQ ID NO: 329292 - protein, 20 aa, Artificial Sequence
  Description of Artificial Sequence: Synthetic peptide
  Seed: ILLVLMAVVLASLIYRRRLM (PMEL_HUMAN)
  Core: LMAVVLASL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILLVXMAXVXASXIYRRRLM

SEQ ID NO: 329293 - protein, 20 aa, Artificial Sequence
  Description of Artificial Sequence: Synthetic peptide
  Seed: ILLVLMAVVLASLIYRRRLM (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRLM

SEQ ID NO: 329294 - protein, 20 aa, Artificial Sequence
  Description of Artificial Sequence: Synthetic peptide
  Seed: ILLVLMAVVLASLIYRRRLM (PMEL_HUMAN)
  Core: AVVLASLIY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMXVVXAXLIXRRRLM

SEQ ID NO: 329295 - protein, 20 aa, Artificial Sequence
  Description of Artificial Sequence: Synthetic peptide
  Seed: ILLVLMAVVLASLIYRRRLM (PMEL_HUMAN)
  Core: VVLASLIYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAXVLXSXIYXRRLM

SEQ ID NO: 329296 - protein, 20 aa, Artificial Sequence
  Description of Artificial Sequence: Synthetic peptide
  Seed: ILLVLMAVVLASLIYRRRLM (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRLM

SEQ ID NO: 329297 - protein, 20 aa, Artificial Sequence
  Description of Artificial Sequence: Synthetic peptide
  Seed: ILLVLMAVVLASLIYRRRLM (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXLM

SEQ ID NO: 329298 - protein, 21 aa, Artificial Sequence
  Description of Artificial Sequence: Synthetic peptide
  Seed: ILLVLMAVVLASLIYRRRLMK (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRRLMK

SEQ ID NO: 329299 - protein, 21 aa, Artificial Sequence
  Description of Artificial Sequence: Synthetic peptide
  Seed: ILLVLMAVVLASLIYRRRLMK (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRLMK

SEQ ID NO: 329300 - protein, 21 aa, Artificial Sequence
  Description of Artificial Sequence: Synthetic peptide
  Seed: ILLVLMAVVLASLIYRRRLMK (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRLMK

SEQ ID NO: 329301 - protein, 21 aa, Artificial Sequence
  Description of Artificial Sequence: Synthetic peptide
  Seed: ILLVLMAVVLASLIYRRRLMK (PMEL_HUMAN)
  Core: AVVLASLIY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMXVVXAXLIXRRRLMK

SEQ ID NO: 329302 - protein, 21 aa, Artificial Sequence
  Description of Artificial Sequence: Synthetic peptide
  Seed: ILLVLMAVVLASLIYRRRLMK (PMEL_HUMAN)
  Core: VVLASLIYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAXVLXSXIYXRRLMK

SEQ ID NO: 329303 - protein, 21 aa, Artificial Sequence
  Description of Artificial Sequence: Synthetic peptide
  Seed: ILLVLMAVVLASLIYRRRLMK (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRLMK

SEQ ID NO: 329304 - protein, 21 aa, Artificial Sequence
  Description of Artificial Sequence: Synthetic peptide
  Seed: ILLVLMAVVLASLIYRRRLMK (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXLMK

SEQ ID NO: 329305 - protein, 21 aa, Artificial Sequence
  Description of Artificial Sequence: Synthetic peptide
  Seed: ILLVLMAVVLASLIYRRRLMK (PMEL_HUMAN)
  Core: SLIYRRRLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLAXLIXRXRLXK

SEQ ID NO: 329306 - protein, 22 aa, Artificial Sequence
  Description of Artificial Sequence: Synthetic peptide
  Seed: ILLVLMAVVLASLIYRRRLMKQ (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRRLMKQ

SEQ ID NO: 329307 - protein, 22 aa, Artificial Sequence
  Description of Artificial Sequence: Synthetic peptide
  Seed: ILLVLMAVVLASLIYRRRLMKQ (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRLMKQ

SEQ ID NO: 329308 - protein, 22 aa, Artificial Sequence
  Description of Artificial Sequence: Synthetic peptide
  Seed: ILLVLMAVVLASLIYRRRLMKQ (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRLMKQ

SEQ ID NO: 329309 - protein, 22 aa, Artificial Sequence
  Description of Artificial Sequence: Synthetic peptide
  Seed: ILLVLMAVVLASLIYRRRLMKQ (PMEL_HUMAN)
  Core: VVLASLIYR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAXVLXSXIYXRRLMKQ

SEQ ID NO: 329310 - protein, 22 aa, Artificial Sequence
  Description of Artificial Sequence: Synthetic peptide
  Seed: ILLVLMAVVLASLIYRRRLMKQ (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRLMKQ

SEQ ID NO: 329311 - protein, 22 aa, Artificial Sequence
  Description of Artificial Sequence: Synthetic peptide
  Seed: ILLVLMAVVLASLIYRRRLMKQ (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXLMKQ

SEQ ID NO: 329312 - protein, 22 aa, Artificial Sequence
  Description of Artificial Sequence: Synthetic peptide
  Seed: ILLVLMAVVLASLIYRRRLMKQ (PMEL_HUMAN)
  Core: ASLIYRRRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLXSLXYXRRXMKQ

SEQ ID NO: 329313 - protein, 22 aa, Artificial Sequence
  Description of Artificial Sequence: Synthetic peptide
  Seed: ILLVLMAVVLASLIYRRRLMKQ (PMEL_HUMAN)
  Core: SLIYRRRLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLAXLIXRXRLXKQ

SEQ ID NO: 329314 - protein, 22 aa, Artificial Sequence
  Description of Artificial Sequence: Synthetic peptide
  Seed: ILLVLMAVVLASLIYRRRLMKQ (PMEL_HUMAN)
  Core: LIYRRRLMK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASXIYXRXLMXQ

SEQ ID NO: 329315 - protein, 23 aa, Artificial Sequence
  Description of Artificial Sequence: Synthetic peptide
  Seed: ILLVLMAVVLASLIYRRRLMKQD (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRRLMKQD

SEQ ID NO: 329316 - protein, 23 aa, Artificial Sequence
  Description of Artificial Sequence: Synthetic peptide
  Seed: ILLVLMAVVLASLIYRRRLMKQD (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRLMKQD

SEQ ID NO: 329317 - protein, 23 aa, Artificial Sequence
  Description of Artificial Sequence: Synthetic peptide
  Seed: ILLVLMAVVLASLIYRRRLMKQD (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRLMKQD

SEQ ID NO: 329318 - protein, 23 aa, Artificial Sequence
  Description of Artificial Sequence: Synthetic peptide
  Seed: ILLVLMAVVLASLIYRRRLMKQD (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRLMKQD

SEQ ID NO: 329319 - protein, 23 aa, Artificial Sequence
  Description of Artificial Sequence: Synthetic peptide
  Seed: ILLVLMAVVLASLIYRRRLMKQD (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXLMKQD

SEQ ID NO: 329320 - protein, 23 aa, Artificial Sequence
  Description of Artificial Sequence: Synthetic peptide
  Seed: ILLVLMAVVLASLIYRRRLMKQD (PMEL_HUMAN)
  Core: ASLIYRRRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLXSLXYXRRXMKQD

SEQ ID NO: 329321 - protein, 23 aa, Artificial Sequence
  Description of Artificial Sequence: Synthetic peptide
  Seed: ILLVLMAVVLASLIYRRRLMKQD (PMEL_HUMAN)
  Core: SLIYRRRLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLAXLIXRXRLXKQD

SEQ ID NO: 329322 - protein, 23 aa, Artificial Sequence
  Description of Artificial Sequence: Synthetic peptide
  Seed: ILLVLMAVVLASLIYRRRLMKQD (PMEL_HUMAN)
  Core: LIYRRRLMK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASXIYXRXLMXQD

SEQ ID NO: 329323 - protein, 24 aa, Artificial Sequence
  Description of Artificial Sequence: Synthetic peptide
  Seed: ILLVLMAVVLASLIYRRRLMKQDF (PMEL_HUMAN)
  Core: LVLMAVVLA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ILXVLXAXVLXSLIYRRRLMKQDF

SEQ ID NO: 329324 - protein, 24 aa, Artificial Sequence
  Description of Artificial Sequence: Synthetic peptide
  Seed: ILLVLMAVVLASLIYRRRLMKQDF (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRLMKQDF

SEQ ID NO: 329325 - protein, 24 aa, Artificial Sequence
  Description of Artificial Sequence: Synthetic peptide
  Seed: ILLVLMAVVLASLIYRRRLMKQDF (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRLMKQDF

SEQ ID NO: 329326 - protein, 24 aa, Artificial Sequence
  Description of Artificial Sequence: Synthetic peptide
  Seed: ILLVLMAVVLASLIYRRRLMKQDF (PMEL_HUMAN)
  Core: AVVLASLIY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMXVVXAXLIXRRRLMKQDF

SEQ ID NO: 329327 - protein, 24 aa, Artificial Sequence
  Description of Artificial Sequence: Synthetic peptide
  Seed: ILLVLMAVVLASLIYRRRLMKQDF (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRLMKQDF

SEQ ID NO: 329328 - protein, 24 aa, Artificial Sequence
  Description of Artificial Sequence: Synthetic peptide
  Seed: ILLVLMAVVLASLIYRRRLMKQDF (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXLMKQDF

SEQ ID NO: 329329 - protein, 24 aa, Artificial Sequence
  Description of Artificial Sequence: Synthetic peptide
  Seed: ILLVLMAVVLASLIYRRRLMKQDF (PMEL_HUMAN)
  Core: ASLIYRRRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLXSLXYXRRXMKQDF

SEQ ID NO: 329330 - protein, 24 aa, Artificial Sequence
  Description of Artificial Sequence: Synthetic peptide
  Seed: ILLVLMAVVLASLIYRRRLMKQDF (PMEL_HUMAN)
  Core: SLIYRRRLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLAXLIXRXRLXKQDF

SEQ ID NO: 329331 - protein, 24 aa, Artificial Sequence
  Description of Artificial Sequence: Synthetic peptide
  Seed: ILLVLMAVVLASLIYRRRLMKQDF (PMEL_HUMAN)
  Core: LIYRRRLMK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASXIYXRXLMXQDF

SEQ ID NO: 329332 - protein, 24 aa, Artificial Sequence
  Description of Artificial Sequence: Synthetic peptide
  Seed: ILLVLMAVVLASLIYRRRLMKQDF (PMEL_HUMAN)
  Core: IYRRRLMKQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASLXYRXRXMKXDF

SEQ ID NO: 329333 - protein, 24 aa, Artificial Sequence
  Description of Artificial Sequence: Synthetic peptide
  Seed: ILLVLMAVVLASLIYRRRLMKQDF (PMEL_HUMAN)
  Core: YRRRLMKQD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASLIXRRXLXKQXF

SEQ ID NO: 329334 - protein, 25 aa, Artificial Sequence
  Description of Artificial Sequence: Synthetic peptide
  Seed: ILLVLMAVVLASLIYRRRLMKQDFS (PMEL_HUMAN)
  Core: VLMAVVLAS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ILLXLMXVXLAXLIYRRRLMKQDFS

SEQ ID NO: 329335 - protein, 25 aa, Artificial Sequence
  Description of Artificial Sequence: Synthetic peptide
  Seed: ILLVLMAVVLASLIYRRRLMKQDFS (PMEL_HUMAN)
  Core: MAVVLASLI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLXAVXLXSLXYRRRLMKQDFS

SEQ ID NO: 329336 - protein, 25 aa, Artificial Sequence
  Description of Artificial Sequence: Synthetic peptide
  Seed: ILLVLMAVVLASLIYRRRLMKQDFS (PMEL_HUMAN)
  Core: AVVLASLIY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMXVVXAXLIXRRRLMKQDFS

SEQ ID NO: 329337 - protein, 25 aa, Artificial Sequence
  Description of Artificial Sequence: Synthetic peptide
  Seed: ILLVLMAVVLASLIYRRRLMKQDFS (PMEL_HUMAN)
  Core: VLASLIYRR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVXLAXLXYRXRLMKQDFS

SEQ ID NO: 329338 - protein, 25 aa, Artificial Sequence
  Description of Artificial Sequence: Synthetic peptide
  Seed: ILLVLMAVVLASLIYRRRLMKQDFS (PMEL_HUMAN)
  Core: LASLIYRRR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVXASXIXRRXLMKQDFS

SEQ ID NO: 329339 - protein, 25 aa, Artificial Sequence
  Description of Artificial Sequence: Synthetic peptide
  Seed: ILLVLMAVVLASLIYRRRLMKQDFS (PMEL_HUMAN)
  Core: ASLIYRRRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLXSLXYXRRXMKQDFS

SEQ ID NO: 329340 - protein, 25 aa, Artificial Sequence
  Description of Artificial Sequence: Synthetic peptide
  Seed: ILLVLMAVVLASLIYRRRLMKQDFS (PMEL_HUMAN)
  Core: SLIYRRRLM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLAXLIXRXRLXKQDFS

SEQ ID NO: 329341 - protein, 25 aa, Artificial Sequence
  Description of Artificial Sequence: Synthetic peptide
  Seed: ILLVLMAVVLASLIYRRRLMKQDFS (PMEL_HUMAN)
  Core: LIYRRRLMK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASXIYXRXLMXQDFS

SEQ ID NO: 329342 - protein, 25 aa, Artificial Sequence
  Description of Artificial Sequence: Synthetic peptide
  Seed: ILLVLMAVVLASLIYRRRLMKQDFS (PMEL_HUMAN)
  Core: IYRRRLMKQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASLXYRXRXMKXDFS

SEQ ID NO: 329343 - protein, 25 aa, Artificial Sequence
  Description of Artificial Sequence: Synthetic peptide
  Seed: ILLVLMAVVLASLIYRRRLMKQDFS (PMEL_HUMAN)
  Core: YRRRLMKQD
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ILLVLMAVVLASLIXRRXLXKQXFS

SEQ ID NO: 329344 - protein, 15 aa, Artificial Sequence
  Description of Artificial Sequence: Synthetic peptide
  Seed: ILQAVPSGEGDAFEL (PMEL_HUMAN)
  Core: VPSGEGDAF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ILQAXPSXEXDAXEL

SEQ ID NO: 329345 - protein, 15 aa, Artificial Sequence
  Description of Artificial Sequence: Synthetic peptide
  Seed: IMPGQEAGLGQVPLI (PMEL_HUMAN)
  Core: QEAGLGQVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IMPGXEAXLXQVXLI

SEQ ID NO: 329346 - protein, 16 aa, Artificial Sequence
  Description of Artificial Sequence: Synthetic peptide
  Seed: IMPGQEAGLGQVPLIV (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXV

SEQ ID NO: 329347 - protein, 17 aa, Artificial Sequence
  Description of Artificial Sequence: Synthetic peptide
  Seed: IMPGQEAGLGQVPLIVG (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVG

SEQ ID NO: 329348 - protein, 18 aa, Artificial Sequence
  Description of Artificial Sequence: Synthetic peptide
  Seed: IMPGQEAGLGQVPLIVGI (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGI

SEQ ID NO: 329349 - protein, 19 aa, Artificial Sequence
  Description of Artificial Sequence: Synthetic peptide
  Seed: IMPGQEAGLGQVPLIVGIL (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGIL

SEQ ID NO: 329350 - protein, 19 aa, Artificial Sequence
  Description of Artificial Sequence: Synthetic peptide
  Seed: IMPGQEAGLGQVPLIVGIL (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXIL

SEQ ID NO: 329351 - protein, 20 aa, Artificial Sequence
  Description of Artificial Sequence: Synthetic peptide
  Seed: IMPGQEAGLGQVPLIVGILL (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGILL

SEQ ID NO: 329352 - protein, 20 aa, Artificial Sequence
  Description of Artificial Sequence: Synthetic peptide
  Seed: IMPGQEAGLGQVPLIVGILL (PMEL_HUMAN)
  Core: GLGQVPLIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAXLGXVXLIXGILL

SEQ ID NO: 329353 - protein, 20 aa, Artificial Sequence
  Description of Artificial Sequence: Synthetic peptide
  Seed: IMPGQEAGLGQVPLIVGILL (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXILL

SEQ ID NO: 329354 - protein, 21 aa, Artificial Sequence
  Description of Artificial Sequence: Synthetic peptide
  Seed: IMPGQEAGLGQVPLIVGILLV (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGILLV

SEQ ID NO: 329355 - protein, 21 aa, Artificial Sequence
  Description of Artificial Sequence: Synthetic peptide
  Seed: IMPGQEAGLGQVPLIVGILLV (PMEL_HUMAN)
  Core: GLGQVPLIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAXLGXVXLIXGILLV

SEQ ID NO: 329356 - protein, 21 aa, Artificial Sequence
  Description of Artificial Sequence: Synthetic peptide
  Seed: IMPGQEAGLGQVPLIVGILLV (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXILLV

SEQ ID NO: 329357 - protein, 22 aa, Artificial Sequence
  Description of Artificial Sequence: Synthetic peptide
  Seed: IMPGQEAGLGQVPLIVGILLVL (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGILLVL

SEQ ID NO: 329358 - protein, 22 aa, Artificial Sequence
  Description of Artificial Sequence: Synthetic peptide
  Seed: IMPGQEAGLGQVPLIVGILLVL (PMEL_HUMAN)
  Core: GLGQVPLIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAXLGXVXLIXGILLVL

SEQ ID NO: 329359 - protein, 22 aa, Artificial Sequence
  Description of Artificial Sequence: Synthetic peptide
  Seed: IMPGQEAGLGQVPLIVGILLVL (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXILLVL

SEQ ID NO: 329360 - protein, 23 aa, Artificial Sequence
  Description of Artificial Sequence: Synthetic peptide
  Seed: IMPGQEAGLGQVPLIVGILLVLM (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGILLVLM

SEQ ID NO: 329361 - protein, 23 aa, Artificial Sequence
  Description of Artificial Sequence: Synthetic peptide
  Seed: IMPGQEAGLGQVPLIVGILLVLM (PMEL_HUMAN)
  Core: GLGQVPLIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAXLGXVXLIXGILLVLM

SEQ ID NO: 329362 - protein, 23 aa, Artificial Sequence
  Description of Artificial Sequence: Synthetic peptide
  Seed: IMPGQEAGLGQVPLIVGILLVLM (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXILLVLM

SEQ ID NO: 329363 - protein, 24 aa, Artificial Sequence
  Description of Artificial Sequence: Synthetic peptide
  Seed: IMPGQEAGLGQVPLIVGILLVLMA (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGILLVLMA

SEQ ID NO: 329364 - protein, 24 aa, Artificial Sequence
  Description of Artificial Sequence: Synthetic peptide
  Seed: IMPGQEAGLGQVPLIVGILLVLMA (PMEL_HUMAN)
  Core: GLGQVPLIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAXLGXVXLIXGILLVLMA

SEQ ID NO: 329365 - protein, 24 aa, Artificial Sequence
  Description of Artificial Sequence: Synthetic peptide
  Seed: IMPGQEAGLGQVPLIVGILLVLMA (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXILLVLMA

SEQ ID NO: 329366 - protein, 25 aa, Artificial Sequence
  Description of Artificial Sequence: Synthetic peptide
  Seed: IMPGQEAGLGQVPLIVGILLVLMAV (PMEL_HUMAN)
  Core: AGLGQVPLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEXGLXQXPLXVGILLVLMAV

SEQ ID NO: 329367 - protein, 25 aa, Artificial Sequence
  Description of Artificial Sequence: Synthetic peptide
  Seed: IMPGQEAGLGQVPLIVGILLVLMAV (PMEL_HUMAN)
  Core: GLGQVPLIV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAXLGXVXLIXGILLVLMAV

SEQ ID NO: 329368 - protein, 25 aa, Artificial Sequence
  Description of Artificial Sequence: Synthetic peptide
  Seed: IMPGQEAGLGQVPLIVGILLVLMAV (PMEL_HUMAN)
  Core: LGQVPLIVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGXGQXPXIVXILLVLMAV

SEQ ID NO: 329369 - protein, 25 aa, Artificial Sequence
  Description of Artificial Sequence: Synthetic peptide
  Seed: IMPGQEAGLGQVPLIVGILLVLMAV (PMEL_HUMAN)
  Core: LIVGILLVL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IMPGQEAGLGQVPXIVXIXLVXMAV

SEQ ID NO: 329370 - protein, 15 aa, Artificial Sequence
  Description of Artificial Sequence: Synthetic peptide
  Seed: IMSTESITGSLGPLL (PMEL_HUMAN)
  Core: TESITGSLG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IMSXESXTXSLXPLL

SEQ ID NO: 329371 - protein, 15 aa, Artificial Sequence
  Description of Artificial Sequence: Synthetic peptide
  Seed: IMSTESITGSLGPLL (PMEL_HUMAN)
  Core: SITGSLGPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IMSTEXITXSXGPXL

SEQ ID NO: 329372 - protein, 15 aa, Artificial Sequence
  Description of Artificial Sequence: Synthetic peptide
  Seed: IMSTESITGSLGPLL (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLX

SEQ ID NO: 329373 - protein, 16 aa, Artificial Sequence
  Description of Artificial Sequence: Synthetic peptide
  Seed: IMSTESITGSLGPLLD (PMEL_HUMAN)
  Core: SITGSLGPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IMSTEXITXSXGPXLD

SEQ ID NO: 329374 - protein, 16 aa, Artificial Sequence
  Description of Artificial Sequence: Synthetic peptide
  Seed: IMSTESITGSLGPLLD (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXD

SEQ ID NO: 329375 - protein, 17 aa, Artificial Sequence
  Description of Artificial Sequence: Synthetic peptide
  Seed: IMSTESITGSLGPLLDG (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDG

SEQ ID NO: 329376 - protein, 19 aa, Artificial Sequence
  Description of Artificial Sequence: Synthetic peptide
  Seed: IMSTESITGSLGPLLDGTA (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTA

SEQ ID NO: 329377 - protein, 20 aa, Artificial Sequence
  Description of Artificial Sequence: Synthetic peptide
  Seed: IMSTESITGSLGPLLDGTAT (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTAT

SEQ ID NO: 329378 - protein, 21 aa, Artificial Sequence
  Description of Artificial Sequence: Synthetic peptide
  Seed: IMSTESITGSLGPLLDGTATL (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTATL

SEQ ID NO: 329379 - protein, 22 aa, Artificial Sequence
  Description of Artificial Sequence: Synthetic peptide
  Seed: IMSTESITGSLGPLLDGTATLR (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTATLR

SEQ ID NO: 329380 - protein, 23 aa, Artificial Sequence
  Description of Artificial Sequence: Synthetic peptide
  Seed: IMSTESITGSLGPLLDGTATLRL (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTATLRL

SEQ ID NO: 329381 - protein, 24 aa, Artificial Sequence
  Description of Artificial Sequence: Synthetic peptide
  Seed: IMSTESITGSLGPLLDGTATLRLV (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTATLRLV

SEQ ID NO: 329382 - protein, 24 aa, Artificial Sequence
  Description of Artificial Sequence: Synthetic peptide
  Seed: IMSTESITGSLGPLLDGTATLRLV (PMEL_HUMAN)
  Core: LGPLLDGTA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESITGSXGPXLXGTXTLRLV

SEQ ID NO: 329383 - protein, 24 aa, Artificial Sequence
  Description of Artificial Sequence: Synthetic peptide
  Seed: IMSTESITGSLGPLLDGTATLRLV (PMEL_HUMAN)
  Core: LDGTATLRL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESITGSLGPLXDGXAXLRXV

SEQ ID NO: 329384 - protein, 25 aa, Artificial Sequence
  Description of Artificial Sequence: Synthetic peptide
  Seed: IMSTESITGSLGPLLDGTATLRLVK (PMEL_HUMAN)
  Core: ITGSLGPLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESXTGXLXPLXDGTATLRLVK

SEQ ID NO: 329385 - protein, 25 aa, Artificial Sequence
  Description of Artificial Sequence: Synthetic peptide
  Seed: IMSTESITGSLGPLLDGTATLRLVK (PMEL_HUMAN)
  Core: LGPLLDGTA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESITGSXGPXLXGTXTLRLVK

SEQ ID NO: 329386 - protein, 25 aa, Artificial Sequence
  Description of Artificial Sequence: Synthetic peptide
  Seed: IMSTESITGSLGPLLDGTATLRLVK (PMEL_HUMAN)
  Core: LDGTATLRL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IMSTESITGSLGPLXDGXAXLRXVK

SEQ ID NO: 329387 - protein, 13 aa, Artificial Sequence
  Description of Artificial Sequence: Synthetic peptide
  Seed: INGSQVWGGQPVY (PMEL_HUMAN)
  Core: INGSQVWGG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XNGXQXWGXQPVY

SEQ ID NO: 329388 - protein, 14 aa, Artificial Sequence
  Description of Artificial Sequence: Synthetic peptide
  Seed: INGSQVWGGQPVYP (PMEL_HUMAN)
  Core: INGSQVWGG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XNGXQXWGXQPVYP

SEQ ID NO: 329389 - protein, 14 aa, Artificial Sequence
  Description of Artificial Sequence: Synthetic peptide
  Seed: INGSQVWGGQPVYP (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYX

SEQ ID NO: 329390 - protein, 15 aa, Artificial Sequence
  Description of Artificial Sequence: Synthetic peptide
  Seed: INGSQVWGGQPVYPQ (PMEL_HUMAN)
  Core: INGSQVWGG
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XNGXQXWGXQPVYPQ

SEQ ID NO: 329391 - protein, 15 aa, Artificial Sequence
  Description of Artificial Sequence: Synthetic peptide
  Seed: INGSQVWGGQPVYPQ (PMEL_HUMAN)
  Core: SQVWGGQPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
INGXQVXGXQPXYPQ

SEQ ID NO: 329392 - protein, 15 aa, Artificial Sequence
  Description of Artificial Sequence: Synthetic peptide
  Seed: INGSQVWGGQPVYPQ (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQ

SEQ ID NO: 329393 - protein, 16 aa, Artificial Sequence
  Description of Artificial Sequence: Synthetic peptide
  Seed: INGSQVWGGQPVYPQE (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQE

SEQ ID NO: 329394 - protein, 17 aa, Artificial Sequence
  Description of Artificial Sequence: Synthetic peptide
  Seed: INGSQVWGGQPVYPQET (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQET

SEQ ID NO: 329395 - protein, 18 aa, Artificial Sequence
  Description of Artificial Sequence: Synthetic peptide
  Seed: INGSQVWGGQPVYPQETD (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETD

SEQ ID NO: 329396 - protein, 19 aa, Artificial Sequence
  Description of Artificial Sequence: Synthetic peptide
  Seed: INGSQVWGGQPVYPQETDD (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDD

SEQ ID NO: 329397 - protein, 20 aa, Artificial Sequence
  Description of Artificial Sequence: Synthetic peptide
  Seed: INGSQVWGGQPVYPQETDDA (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDDA

SEQ ID NO: 329398 - protein, 21 aa, Artificial Sequence
  Description of Artificial Sequence: Synthetic peptide
  Seed: INGSQVWGGQPVYPQETDDAC (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDDAC

SEQ ID NO: 329399 - protein, 22 aa, Artificial Sequence
  Description of Artificial Sequence: Synthetic peptide
  Seed: INGSQVWGGQPVYPQETDDACI (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDDACI

SEQ ID NO: 329400 - protein, 23 aa, Artificial Sequence
  Description of Artificial Sequence: Synthetic peptide
  Seed: INGSQVWGGQPVYPQETDDACIF (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDDACIF

SEQ ID NO: 329401 - protein, 24 aa, Artificial Sequence
  Description of Artificial Sequence: Synthetic peptide
  Seed: INGSQVWGGQPVYPQETDDACIFP (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDDACIFP

SEQ ID NO: 329402 - protein, 25 aa, Artificial Sequence
  Description of Artificial Sequence: Synthetic peptide
  Seed: INGSQVWGGQPVYPQETDDACIFPD (PMEL_HUMAN)
  Core: VWGGQPVYP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
INGSQXWGXQXVYXQETDDACIFPD

SEQ ID NO: 329403 - protein, 15 aa, Artificial Sequence
  Description of Artificial Sequence: Synthetic peptide
  Seed: IPEPEGPDASSIMST (PMEL_HUMAN)
  Core: PEGPDASSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IPEXEGXDXSSXMST

SEQ ID NO: 329404 - protein, 15 aa, Artificial Sequence
  Description of Artificial Sequence: Synthetic peptide
  Seed: IPEPEGPDASSIMST (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSX

SEQ ID NO: 329405 - protein, 16 aa, Artificial Sequence
  Description of Artificial Sequence: Synthetic peptide
  Seed: IPEPEGPDASSIMSTE (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXE

SEQ ID NO: 329406 - protein, 17 aa, Artificial Sequence
  Description of Artificial Sequence: Synthetic peptide
  Seed: IPEPEGPDASSIMSTES (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXES

SEQ ID NO: 329407 - protein, 18 aa, Artificial Sequence
  Description of Artificial Sequence: Synthetic peptide
  Seed: IPEPEGPDASSIMSTESI (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESI

SEQ ID NO: 329408 - protein, 19 aa, Artificial Sequence
  Description of Artificial Sequence: Synthetic peptide
  Seed: IPEPEGPDASSIMSTESIT (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESIT

SEQ ID NO: 329409 - protein, 20 aa, Artificial Sequence
  Description of Artificial Sequence: Synthetic peptide
  Seed: IPEPEGPDASSIMSTESITG (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESITG

SEQ ID NO: 329410 - protein, 21 aa, Artificial Sequence
  Description of Artificial Sequence: Synthetic peptide
  Seed: IPEPEGPDASSIMSTESITGS (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESITGS

SEQ ID NO: 329411 - protein, 22 aa, Artificial Sequence
  Description of Artificial Sequence: Synthetic peptide
  Seed: IPEPEGPDASSIMSTESITGSL (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESITGSL

SEQ ID NO: 329412 - protein, 23 aa, Artificial Sequence
  Description of Artificial Sequence: Synthetic peptide
  Seed: IPEPEGPDASSIMSTESITGSLG (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESITGSLG

SEQ ID NO: 329413 - protein, 24 aa, Artificial Sequence
  Description of Artificial Sequence: Synthetic peptide
  Seed: IPEPEGPDASSIMSTESITGSLGP (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESITGSLGP

SEQ ID NO: 329414 - protein, 25 aa, Artificial Sequence
  Description of Artificial Sequence: Synthetic peptide
  Seed: IPEPEGPDASSIMSTESITGSLGPL (PMEL_HUMAN)
  Core: PDASSIMST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IPEPEGXDAXSXMSXESITGSLGPL

SEQ ID NO: 329415 - protein, 14 aa, Artificial Sequence
  Description of Artificial Sequence: Synthetic peptide
  Seed: IPLTSCGSSPVPGT (PMEL_HUMAN)
  Core: LTSCGSSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IPXTSXGXSPXPGT

SEQ ID NO: 329416 - protein, 15 aa, Artificial Sequence
  Description of Artificial Sequence: Synthetic peptide
  Seed: IPLTSCGSSPVPGTT (PMEL_HUMAN)
  Core: LTSCGSSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IPXTSXGXSPXPGTT

SEQ ID NO: 329417 - protein, 15 aa, Artificial Sequence
  Description of Artificial Sequence: Synthetic peptide
  Seed: IPLTSCGSSPVPGTT (PMEL_HUMAN)
  Core: SCGSSPVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPLTXCGXSXVPXTT

SEQ ID NO: 329418 - protein, 16 aa, Artificial Sequence
  Description of Artificial Sequence: Synthetic peptide
  Seed: IPLTSCGSSPVPGTTD (PMEL_HUMAN)
  Core: SCGSSPVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPLTXCGXSXVPXTTD

SEQ ID NO: 329419 - protein, 17 aa, Artificial Sequence
  Description of Artificial Sequence: Synthetic peptide
  Seed: IPLTSCGSSPVPGTTDG (PMEL_HUMAN)
  Core: SCGSSPVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPLTXCGXSXVPXTTDG

SEQ ID NO: 329420 - protein, 19 aa, Artificial Sequence
  Description of Artificial Sequence: Synthetic peptide
  Seed: IPLTSCGSSPVPGTTDGHR (PMEL_HUMAN)
  Core: SCGSSPVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IPLTXCGXSXVPXTTDGHR

SEQ ID NO: 329421 - protein, 20 aa, Artificial Sequence
  Description of Artificial Sequence: Synthetic peptide
  Seed: IPLTSCGSSPVPGTTDGHRP (PMEL_HUMAN)
  Core: PVPGTTDGH
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IPLTSCGSSXVPXTXDGXRP

SEQ ID NO: 329422 - protein, 14 aa, Artificial Sequence
  Description of Artificial Sequence: Synthetic peptide
  Seed: ISRALVVTHTYLEP (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXP

SEQ ID NO: 329423 - protein, 14 aa, Artificial Sequence
  Description of Artificial Sequence: Synthetic peptide
  Seed: ISRALVVTHTYLEP (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEX

SEQ ID NO: 329424 - protein, 15 aa, Artificial Sequence
  Description of Artificial Sequence: Synthetic peptide
  Seed: ISRALVVTHTYLEPG (PMEL_HUMAN)
  Core: RALVVTHTY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ISXALXVXHTXLEPG

SEQ ID NO: 329425 - protein, 15 aa, Artificial Sequence
  Description of Artificial Sequence: Synthetic peptide
  Seed: ISRALVVTHTYLEPG (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPG

SEQ ID NO: 329426 - protein, 15 aa, Artificial Sequence
  Description of Artificial Sequence: Synthetic peptide
  Seed: ISRALVVTHTYLEPG (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXG

SEQ ID NO: 329427 - protein, 15 aa, Artificial Sequence
  Description of Artificial Sequence: Synthetic peptide
  Seed: ISRALVVTHTYLEPG (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPX

SEQ ID NO: 329428 - protein, 16 aa, Artificial Sequence
  Description of Artificial Sequence: Synthetic peptide
  Seed: ISRALVVTHTYLEPGP (PMEL_HUMAN)
  Core: RALVVTHTY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ISXALXVXHTXLEPGP

SEQ ID NO: 329429 - protein, 16 aa, Artificial Sequence
  Description of Artificial Sequence: Synthetic peptide
  Seed: ISRALVVTHTYLEPGP (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGP

SEQ ID NO: 329430 - protein, 16 aa, Artificial Sequence
  Description of Artificial Sequence: Synthetic peptide
  Seed: ISRALVVTHTYLEPGP (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGP

SEQ ID NO: 329431 - protein, 16 aa, Artificial Sequence
  Description of Artificial Sequence: Synthetic peptide
  Seed: ISRALVVTHTYLEPGP (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXP

SEQ ID NO: 329432 - protein, 17 aa, Artificial Sequence
  Description of Artificial Sequence: Synthetic peptide
  Seed: ISRALVVTHTYLEPGPV (PMEL_HUMAN)
  Core: SRALVVTHT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXRAXVXTHXYLEPGPV

SEQ ID NO: 329433 - protein, 17 aa, Artificial Sequence
  Description of Artificial Sequence: Synthetic peptide
  Seed: ISRALVVTHTYLEPGPV (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPV

SEQ ID NO: 329434 - protein, 17 aa, Artificial Sequence
  Description of Artificial Sequence: Synthetic peptide
  Seed: ISRALVVTHTYLEPGPV (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPV

SEQ ID NO: 329435 - protein, 17 aa, Artificial Sequence
  Description of Artificial Sequence: Synthetic peptide
  Seed: ISRALVVTHTYLEPGPV (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPV

SEQ ID NO: 329436 - protein, 18 aa, Artificial Sequence
  Description of Artificial Sequence: Synthetic peptide
  Seed: ISRALVVTHTYLEPGPVT (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVT

SEQ ID NO: 329437 - protein, 18 aa, Artificial Sequence
  Description of Artificial Sequence: Synthetic peptide
  Seed: ISRALVVTHTYLEPGPVT (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVT

SEQ ID NO: 329438 - protein, 18 aa, Artificial Sequence
  Description of Artificial Sequence: Synthetic peptide
  Seed: ISRALVVTHTYLEPGPVT (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVT

SEQ ID NO: 329439 - protein, 19 aa, Artificial Sequence
  Description of Artificial Sequence: Synthetic peptide
  Seed: ISRALVVTHTYLEPGPVTA (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTA

SEQ ID NO: 329440 - protein, 19 aa, Artificial Sequence
  Description of Artificial Sequence: Synthetic peptide
  Seed: ISRALVVTHTYLEPGPVTA (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTA

SEQ ID NO: 329441 - protein, 19 aa, Artificial Sequence
  Description of Artificial Sequence: Synthetic peptide
  Seed: ISRALVVTHTYLEPGPVTA (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTA

SEQ ID NO: 329442 - protein, 20 aa, Artificial Sequence
  Description of Artificial Sequence: Synthetic peptide
  Seed: ISRALVVTHTYLEPGPVTAQ (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTAQ

SEQ ID NO: 329443 - protein, 20 aa, Artificial Sequence
  Description of Artificial Sequence: Synthetic peptide
  Seed: ISRALVVTHTYLEPGPVTAQ (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTAQ

SEQ ID NO: 329444 - protein, 20 aa, Artificial Sequence
  Description of Artificial Sequence: Synthetic peptide
  Seed: ISRALVVTHTYLEPGPVTAQ (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTAQ

SEQ ID NO: 329445 - protein, 20 aa, Artificial Sequence
  Description of Artificial Sequence: Synthetic peptide
  Seed: ISRALVVTHTYLEPGPVTAQ (PMEL_HUMAN)
  Core: HTYLEPGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTXTYXEXGPXTAQ

SEQ ID NO: 329446 - protein, 21 aa, Artificial Sequence
  Description of Artificial Sequence: Synthetic peptide
  Seed: ISRALVVTHTYLEPGPVTAQV (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTAQV

SEQ ID NO: 329447 - protein, 21 aa, Artificial Sequence
  Description of Artificial Sequence: Synthetic peptide
  Seed: ISRALVVTHTYLEPGPVTAQV (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTAQV

SEQ ID NO: 329448 - protein, 21 aa, Artificial Sequence
  Description of Artificial Sequence: Synthetic peptide
  Seed: ISRALVVTHTYLEPGPVTAQV (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTAQV

SEQ ID NO: 329449 - protein, 21 aa, Artificial Sequence
  Description of Artificial Sequence: Synthetic peptide
  Seed: ISRALVVTHTYLEPGPVTAQV (PMEL_HUMAN)
  Core: HTYLEPGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTXTYXEXGPXTAQV

SEQ ID NO: 329450 - protein, 22 aa, Artificial Sequence
  Description of Artificial Sequence: Synthetic peptide
  Seed: ISRALVVTHTYLEPGPVTAQVV (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTAQVV

SEQ ID NO: 329451 - protein, 22 aa, Artificial Sequence
  Description of Artificial Sequence: Synthetic peptide
  Seed: ISRALVVTHTYLEPGPVTAQVV (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTAQVV

SEQ ID NO: 329452 - protein, 22 aa, Artificial Sequence
  Description of Artificial Sequence: Synthetic peptide
  Seed: ISRALVVTHTYLEPGPVTAQVV (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTAQVV

SEQ ID NO: 329453 - protein, 22 aa, Artificial Sequence
  Description of Artificial Sequence: Synthetic peptide
  Seed: ISRALVVTHTYLEPGPVTAQVV (PMEL_HUMAN)
  Core: HTYLEPGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTXTYXEXGPXTAQVV

SEQ ID NO: 329454 - protein, 23 aa, Artificial Sequence
  Description of Artificial Sequence: Synthetic peptide
  Seed: ISRALVVTHTYLEPGPVTAQVVL (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTAQVVL

SEQ ID NO: 329455 - protein, 23 aa, Artificial Sequence
  Description of Artificial Sequence: Synthetic peptide
  Seed: ISRALVVTHTYLEPGPVTAQVVL (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTAQVVL

SEQ ID NO: 329456 - protein, 23 aa, Artificial Sequence
  Description of Artificial Sequence: Synthetic peptide
  Seed: ISRALVVTHTYLEPGPVTAQVVL (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTAQVVL

SEQ ID NO: 329457 - protein, 23 aa, Artificial Sequence
  Description of Artificial Sequence: Synthetic peptide
  Seed: ISRALVVTHTYLEPGPVTAQVVL (PMEL_HUMAN)
  Core: HTYLEPGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTXTYXEXGPXTAQVVL

SEQ ID NO: 329458 - protein, 24 aa, Artificial Sequence
  Description of Artificial Sequence: Synthetic peptide
  Seed: ISRALVVTHTYLEPGPVTAQVVLQ (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTAQVVLQ

SEQ ID NO: 329459 - protein, 24 aa, Artificial Sequence
  Description of Artificial Sequence: Synthetic peptide
  Seed: ISRALVVTHTYLEPGPVTAQVVLQ (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTAQVVLQ

SEQ ID NO: 329460 - protein, 24 aa, Artificial Sequence
  Description of Artificial Sequence: Synthetic peptide
  Seed: ISRALVVTHTYLEPGPVTAQVVLQ (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTAQVVLQ

SEQ ID NO: 329461 - protein, 24 aa, Artificial Sequence
  Description of Artificial Sequence: Synthetic peptide
  Seed: ISRALVVTHTYLEPGPVTAQVVLQ (PMEL_HUMAN)
  Core: HTYLEPGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTXTYXEXGPXTAQVVLQ

SEQ ID NO: 329462 - protein, 24 aa, Artificial Sequence
  Description of Artificial Sequence: Synthetic peptide
  Seed: ISRALVVTHTYLEPGPVTAQVVLQ (PMEL_HUMAN)
  Core: PVTAQVVLQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTHTYLEPGXVTXQXVLX

SEQ ID NO: 329463 - protein, 25 aa, Artificial Sequence
  Description of Artificial Sequence: Synthetic peptide
  Seed: ISRALVVTHTYLEPGPVTAQVVLQA (PMEL_HUMAN)
  Core: LVVTHTYLE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ISRAXVVXHXYLXPGPVTAQVVLQA

SEQ ID NO: 329464 - protein, 25 aa, Artificial Sequence
  Description of Artificial Sequence: Synthetic peptide
  Seed: ISRALVVTHTYLEPGPVTAQVVLQA (PMEL_HUMAN)
  Core: VVTHTYLEP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISRALXVTXTXLEXGPVTAQVVLQA

SEQ ID NO: 329465 - protein, 25 aa, Artificial Sequence
  Description of Artificial Sequence: Synthetic peptide
  Seed: ISRALVVTHTYLEPGPVTAQVVLQA (PMEL_HUMAN)
  Core: VTHTYLEPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVXTHXYXEPXPVTAQVVLQA

SEQ ID NO: 329466 - protein, 25 aa, Artificial Sequence
  Description of Artificial Sequence: Synthetic peptide
  Seed: ISRALVVTHTYLEPGPVTAQVVLQA (PMEL_HUMAN)
  Core: HTYLEPGPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTXTYXEXGPXTAQVVLQA

SEQ ID NO: 329467 - protein, 25 aa, Artificial Sequence
  Description of Artificial Sequence: Synthetic peptide
  Seed: ISRALVVTHTYLEPGPVTAQVVLQA (PMEL_HUMAN)
  Core: PGPVTAQVV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTHTYLEXGPXTXQVXLQA

SEQ ID NO: 329468 - protein, 25 aa, Artificial Sequence
  Description of Artificial Sequence: Synthetic peptide
  Seed: ISRALVVTHTYLEPGPVTAQVVLQA (PMEL_HUMAN)
  Core: PVTAQVVLQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
ISRALVVTHTYLEPGXVTXQXVLXA

SEQ ID NO: 329469 - protein, 25 aa, Artificial Sequence
  Description of Artificial Sequence: Synthetic peptide
  Seed: ISSPGCQPPAQRLCQPVLPSPACQL (PMEL_HUMAN)
  Core: QRLCQPVLP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ISSPGCQPPAXRLXQXVLXSPACQL

SEQ ID NO: 329470 - protein, 14 aa, Artificial Sequence
  Description of Artificial Sequence: Synthetic peptide
  Seed: ISTAPVQMPTAEST (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESX

SEQ ID NO: 329471 - protein, 15 aa, Artificial Sequence
  Description of Artificial Sequence: Synthetic peptide
  Seed: ISTAPVQMPTAESTG (PMEL_HUMAN)
  Core: TAPVQMPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ISXAPXQXPTXESTG

SEQ ID NO: 329472 - protein, 15 aa, Artificial Sequence
  Description of Artificial Sequence: Synthetic peptide
  Seed: ISTAPVQMPTAESTG (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXG

SEQ ID NO: 329473 - protein, 16 aa, Artificial Sequence
  Description of Artificial Sequence: Synthetic peptide
  Seed: ISTAPVQMPTAESTGM (PMEL_HUMAN)
  Core: TAPVQMPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ISXAPXQXPTXESTGM

SEQ ID NO: 329474 - protein, 16 aa, Artificial Sequence
  Description of Artificial Sequence: Synthetic peptide
  Seed: ISTAPVQMPTAESTGM (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGM

SEQ ID NO: 329475 - protein, 17 aa, Artificial Sequence
  Description of Artificial Sequence: Synthetic peptide
  Seed: ISTAPVQMPTAESTGMT (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGMT

SEQ ID NO: 329476 - protein, 19 aa, Artificial Sequence
  Description of Artificial Sequence: Synthetic peptide
  Seed: ISTAPVQMPTAESTGMTPE (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGMTPE

SEQ ID NO: 329477 - protein, 20 aa, Artificial Sequence
  Description of Artificial Sequence: Synthetic peptide
  Seed: ISTAPVQMPTAESTGMTPEK (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGMTPEK

SEQ ID NO: 329478 - protein, 21 aa, Artificial Sequence
  Description of Artificial Sequence: Synthetic peptide
  Seed: ISTAPVQMPTAESTGMTPEKV (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGMTPEKV

SEQ ID NO: 329479 - protein, 22 aa, Artificial Sequence
  Description of Artificial Sequence: Synthetic peptide
  Seed: ISTAPVQMPTAESTGMTPEKVP (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGMTPEKVP

SEQ ID NO: 329480 - protein, 23 aa, Artificial Sequence
  Description of Artificial Sequence: Synthetic peptide
  Seed: ISTAPVQMPTAESTGMTPEKVPV (PMEL_HUMAN)
  Core: VQMPTAEST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPXQMXTXESXGMTPEKVPV

SEQ ID NO: 329481 - protein, 24 aa, Artificial Sequence
  Description of Artificial Sequence: Synthetic peptide
  Seed: ISTAPVQMPTAESTGMTPEKVPVS (PMEL_HUMAN)
  Core: STGMTPEKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPVQMPTAEXTGXTXEKXPVS

SEQ ID NO: 329482 - protein, 25 aa, Artificial Sequence
  Description of Artificial Sequence: Synthetic peptide
  Seed: ISTAPVQMPTAESTGMTPEKVPVSE (PMEL_HUMAN)
  Core: STGMTPEKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ISTAPVQMPTAEXTGXTXEKXPVSE

SEQ ID NO: 329483 - protein, 14 aa, Artificial Sequence
  Description of Artificial Sequence: Synthetic peptide
  Seed: ITDQVPFSVSVSQL (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQX

SEQ ID NO: 329484 - protein, 15 aa, Artificial Sequence
  Description of Artificial Sequence: Synthetic peptide
  Seed: ITDQVPFSVSVSQLR (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLR

SEQ ID NO: 329485 - protein, 15 aa, Artificial Sequence
  Description of Artificial Sequence: Synthetic peptide
  Seed: ITDQVPFSVSVSQLR (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXR

SEQ ID NO: 329486 - protein, 15 aa, Artificial Sequence
  Description of Artificial Sequence: Synthetic peptide
  Seed: ITDQVPFSVSVSQLR (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLX

SEQ ID NO: 329487 - protein, 16 aa, Artificial Sequence
  Description of Artificial Sequence: Synthetic peptide
  Seed: ITDQVPFSVSVSQLRA (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLRA

SEQ ID NO: 329488 - protein, 16 aa, Artificial Sequence
  Description of Artificial Sequence: Synthetic peptide
  Seed: ITDQVPFSVSVSQLRA (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRA

SEQ ID NO: 329489 - protein, 16 aa, Artificial Sequence
  Description of Artificial Sequence: Synthetic peptide
  Seed: ITDQVPFSVSVSQLRA (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXA

SEQ ID NO: 329490 - protein, 17 aa, Artificial Sequence
  Description of Artificial Sequence: Synthetic peptide
  Seed: ITDQVPFSVSVSQLRAL (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLRAL

SEQ ID NO: 329491 - protein, 17 aa, Artificial Sequence
  Description of Artificial Sequence: Synthetic peptide
  Seed: ITDQVPFSVSVSQLRAL (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRAL

SEQ ID NO: 329492 - protein, 17 aa, Artificial Sequence
  Description of Artificial Sequence: Synthetic peptide
  Seed: ITDQVPFSVSVSQLRAL (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXAL

SEQ ID NO: 329493 - protein, 17 aa, Artificial Sequence
  Description of Artificial Sequence: Synthetic peptide
  Seed: ITDQVPFSVSVSQLRAL (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAX

SEQ ID NO: 329494 - protein, 18 aa, Artificial Sequence
  Description of Artificial Sequence: Synthetic peptide
  Seed: ITDQVPFSVSVSQLRALD (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLRALD

SEQ ID NO: 329495 - protein, 18 aa, Artificial Sequence
  Description of Artificial Sequence: Synthetic peptide
  Seed: ITDQVPFSVSVSQLRALD (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALD

SEQ ID NO: 329496 - protein, 18 aa, Artificial Sequence
  Description of Artificial Sequence: Synthetic peptide
  Seed: ITDQVPFSVSVSQLRALD (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALD

SEQ ID NO: 329497 - protein, 18 aa, Artificial Sequence
  Description of Artificial Sequence: Synthetic peptide
  Seed: ITDQVPFSVSVSQLRALD (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXD

SEQ ID NO: 329498 - protein, 19 aa, Artificial Sequence
  Description of Artificial Sequence: Synthetic peptide
  Seed: ITDQVPFSVSVSQLRALDG (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLRALDG

SEQ ID NO: 329499 - protein, 19 aa, Artificial Sequence
  Description of Artificial Sequence: Synthetic peptide
  Seed: ITDQVPFSVSVSQLRALDG (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDG

SEQ ID NO: 329500 - protein, 19 aa, Artificial Sequence
  Description of Artificial Sequence: Synthetic peptide
  Seed: ITDQVPFSVSVSQLRALDG (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDG

SEQ ID NO: 329501 - protein, 19 aa, Artificial Sequence
  Description of Artificial Sequence: Synthetic peptide
  Seed: ITDQVPFSVSVSQLRALDG (PMEL_HUMAN)
  Core: SVSVSQLRA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFXVSXSXLRXLDG

SEQ ID NO: 329502 - protein, 19 aa, Artificial Sequence
  Description of Artificial Sequence: Synthetic peptide
  Seed: ITDQVPFSVSVSQLRALDG (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDG

SEQ ID NO: 329503 - protein, 20 aa, Artificial Sequence
  Description of Artificial Sequence: Synthetic peptide
  Seed: ITDQVPFSVSVSQLRALDGG (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLRALDGG

SEQ ID NO: 329504 - protein, 20 aa, Artificial Sequence
  Description of Artificial Sequence: Synthetic peptide
  Seed: ITDQVPFSVSVSQLRALDGG (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDGG

SEQ ID NO: 329505 - protein, 20 aa, Artificial Sequence
  Description of Artificial Sequence: Synthetic peptide
  Seed: ITDQVPFSVSVSQLRALDGG (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDGG

SEQ ID NO: 329506 - protein, 20 aa, Artificial Sequence
  Description of Artificial Sequence: Synthetic peptide
  Seed: ITDQVPFSVSVSQLRALDGG (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDGG

SEQ ID NO: 329507 - protein, 20 aa, Artificial Sequence
  Description of Artificial Sequence: Synthetic peptide
  Seed: ITDQVPFSVSVSQLRALDGG (PMEL_HUMAN)
  Core: VSQLRALDG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSXSQXRXLDXG

SEQ ID NO: 329508 - protein, 21 aa, Artificial Sequence
  Description of Artificial Sequence: Synthetic peptide
  Seed: ITDQVPFSVSVSQLRALDGGN (PMEL_HUMAN)
  Core: QVPFSVSVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ITDXVPXSXSVXQLRALDGGN

SEQ ID NO: 329509 - protein, 21 aa, Artificial Sequence
  Description of Artificial Sequence: Synthetic peptide
  Seed: ITDQVPFSVSVSQLRALDGGN (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDGGN

SEQ ID NO: 329510 - protein, 21 aa, Artificial Sequence
  Description of Artificial Sequence: Synthetic peptide
  Seed: ITDQVPFSVSVSQLRALDGGN (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDGGN

SEQ ID NO: 329511 - protein, 21 aa, Artificial Sequence
  Description of Artificial Sequence: Synthetic peptide
  Seed: ITDQVPFSVSVSQLRALDGGN (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDGGN

SEQ ID NO: 329512 - protein, 21 aa, Artificial Sequence
  Description of Artificial Sequence: Synthetic peptide
  Seed: ITDQVPFSVSVSQLRALDGGN (PMEL_HUMAN)
  Core: VSQLRALDG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSXSQXRXLDXGN

SEQ ID NO: 329513 - protein, 22 aa, Artificial Sequence
  Description of Artificial Sequence: Synthetic peptide
  Seed: ITDQVPFSVSVSQLRALDGGNK (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDGGNK

SEQ ID NO: 329514 - protein, 22 aa, Artificial Sequence
  Description of Artificial Sequence: Synthetic peptide
  Seed: ITDQVPFSVSVSQLRALDGGNK (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDGGNK

SEQ ID NO: 329515 - protein, 22 aa, Artificial Sequence
  Description of Artificial Sequence: Synthetic peptide
  Seed: ITDQVPFSVSVSQLRALDGGNK (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDGGNK

SEQ ID NO: 329516 - protein, 22 aa, Artificial Sequence
  Description of Artificial Sequence: Synthetic peptide
  Seed: ITDQVPFSVSVSQLRALDGGNK (PMEL_HUMAN)
  Core: VSQLRALDG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSXSQXRXLDXGNK

SEQ ID NO: 329517 - protein, 23 aa, Artificial Sequence
  Description of Artificial Sequence: Synthetic peptide
  Seed: ITDQVPFSVSVSQLRALDGGNKH (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDGGNKH

SEQ ID NO: 329518 - protein, 23 aa, Artificial Sequence
  Description of Artificial Sequence: Synthetic peptide
  Seed: ITDQVPFSVSVSQLRALDGGNKH (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDGGNKH

SEQ ID NO: 329519 - protein, 23 aa, Artificial Sequence
  Description of Artificial Sequence: Synthetic peptide
  Seed: ITDQVPFSVSVSQLRALDGGNKH (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDGGNKH

SEQ ID NO: 329520 - protein, 23 aa, Artificial Sequence
  Description of Artificial Sequence: Synthetic peptide
  Seed: ITDQVPFSVSVSQLRALDGGNKH (PMEL_HUMAN)
  Core: VSQLRALDG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSXSQXRXLDXGNKH

SEQ ID NO: 329521 - protein, 24 aa, Artificial Sequence
  Description of Artificial Sequence: Synthetic peptide
  Seed: ITDQVPFSVSVSQLRALDGGNKHF (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDGGNKHF

SEQ ID NO: 329522 - protein, 24 aa, Artificial Sequence
  Description of Artificial Sequence: Synthetic peptide
  Seed: ITDQVPFSVSVSQLRALDGGNKHF (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDGGNKHF

SEQ ID NO: 329523 - protein, 24 aa, Artificial Sequence
  Description of Artificial Sequence: Synthetic peptide
  Seed: ITDQVPFSVSVSQLRALDGGNKHF (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDGGNKHF

SEQ ID NO: 329524 - protein, 24 aa, Artificial Sequence
  Description of Artificial Sequence: Synthetic peptide
  Seed: ITDQVPFSVSVSQLRALDGGNKHF (PMEL_HUMAN)
  Core: VSQLRALDG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSXSQXRXLDXGNKHF

SEQ ID NO: 329525 - protein, 25 aa, Artificial Sequence
  Description of Artificial Sequence: Synthetic peptide
  Seed: ITDQVPFSVSVSQLRALDGGNKHFL (PMEL_HUMAN)
  Core: PFSVSVSQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVXFSXSXSQXRALDGGNKHFL

SEQ ID NO: 329526 - protein, 25 aa, Artificial Sequence
  Description of Artificial Sequence: Synthetic peptide
  Seed: ITDQVPFSVSVSQLRALDGGNKHFL (PMEL_HUMAN)
  Core: FSVSVSQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPXSVXVXQLXALDGGNKHFL

SEQ ID NO: 329527 - protein, 25 aa, Artificial Sequence
  Description of Artificial Sequence: Synthetic peptide
  Seed: ITDQVPFSVSVSQLRALDGGNKHFL (PMEL_HUMAN)
  Core: VSVSQLRAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSXSVXQXRAXDGGNKHFL

SEQ ID NO: 329528 - protein, 25 aa, Artificial Sequence
  Description of Artificial Sequence: Synthetic peptide
  Seed: ITDQVPFSVSVSQLRALDGGNKHFL (PMEL_HUMAN)
  Core: VSQLRALDG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSXSQXRXLDXGNKHFL

SEQ ID NO: 329529 - protein, 25 aa, Artificial Sequence
  Description of Artificial Sequence: Synthetic peptide
  Seed: ITDQVPFSVSVSQLRALDGGNKHFL (PMEL_HUMAN)
  Core: LRALDGGNK
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ITDQVPFSVSVSQXRAXDXGNXHFL

SEQ ID NO: 329530 - protein, 15 aa, Artificial Sequence
  Description of Artificial Sequence: Synthetic peptide
  Seed: ITGSLGPLLDGTATL (PMEL_HUMAN)
  Core: LGPLLDGTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ITGSXGPXLXGTXTL

SEQ ID NO: 329531 - protein, 16 aa, Artificial Sequence
  Description of Artificial Sequence: Synthetic peptide
  Seed: ITGSLGPLLDGTATLR (PMEL_HUMAN)
  Core: LGPLLDGTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ITGSXGPXLXGTXTLR

SEQ ID NO: 329532 - protein, 17 aa, Artificial Sequence
  Description of Artificial Sequence: Synthetic peptide
  Seed: ITGSLGPLLDGTATLRL (PMEL_HUMAN)
  Core: LGPLLDGTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ITGSXGPXLXGTXTLRL

SEQ ID NO: 329533 - protein, 17 aa, Artificial Sequence
  Description of Artificial Sequence: Synthetic peptide
  Seed: ITGSLGPLLDGTATLRL (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRX

SEQ ID NO: 329534 - protein, 18 aa, Artificial Sequence
  Description of Artificial Sequence: Synthetic peptide
  Seed: ITGSLGPLLDGTATLRLV (PMEL_HUMAN)
  Core: LGPLLDGTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ITGSXGPXLXGTXTLRLV

SEQ ID NO: 329535 - protein, 19 aa, Artificial Sequence
  Description of Artificial Sequence: Synthetic peptide
  Seed: ITGSLGPLLDGTATLRLVK (PMEL_HUMAN)
  Core: LGPLLDGTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ITGSXGPXLXGTXTLRLVK

SEQ ID NO: 329536 - protein, 19 aa, Artificial Sequence
  Description of Artificial Sequence: Synthetic peptide
  Seed: ITGSLGPLLDGTATLRLVK (PMEL_HUMAN)
  Core: LLDGTATLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPXLDXTXTLXLVK

SEQ ID NO: 329537 - protein, 19 aa, Artificial Sequence
  Description of Artificial Sequence: Synthetic peptide
  Seed: ITGSLGPLLDGTATLRLVK (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVK

SEQ ID NO: 329538 - protein, 20 aa, Artificial Sequence
  Description of Artificial Sequence: Synthetic peptide
  Seed: ITGSLGPLLDGTATLRLVKR (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVKR

SEQ ID NO: 329539 - protein, 21 aa, Artificial Sequence
  Description of Artificial Sequence: Synthetic peptide
  Seed: ITGSLGPLLDGTATLRLVKRQ (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVKRQ

SEQ ID NO: 329540 - protein, 21 aa, Artificial Sequence
  Description of Artificial Sequence: Synthetic peptide
  Seed: ITGSLGPLLDGTATLRLVKRQ (PMEL_HUMAN)
  Core: DGTATLRLV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLXGTXTXRLXKRQ

SEQ ID NO: 329541 - protein, 22 aa, Artificial Sequence
  Description of Artificial Sequence: Synthetic peptide
  Seed: ITGSLGPLLDGTATLRLVKRQV (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVKRQV

SEQ ID NO: 329542 - protein, 22 aa, Artificial Sequence
  Description of Artificial Sequence: Synthetic peptide
  Seed: ITGSLGPLLDGTATLRLVKRQV (PMEL_HUMAN)
  Core: DGTATLRLV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLXGTXTXRLXKRQV

SEQ ID NO: 329543 - protein, 23 aa, Artificial Sequence
  Description of Artificial Sequence: Synthetic peptide
  Seed: ITGSLGPLLDGTATLRLVKRQVP (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVKRQVP

SEQ ID NO: 329544 - protein, 23 aa, Artificial Sequence
  Description of Artificial Sequence: Synthetic peptide
  Seed: ITGSLGPLLDGTATLRLVKRQVP (PMEL_HUMAN)
  Core: DGTATLRLV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLXGTXTXRLXKRQVP

SEQ ID NO: 329545 - protein, 23 aa, Artificial Sequence
  Description of Artificial Sequence: Synthetic peptide
  Seed: ITGSLGPLLDGTATLRLVKRQVP (PMEL_HUMAN)
  Core: LRLVKRQVP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLDGTATXRLXKXQVX

SEQ ID NO: 329546 - protein, 24 aa, Artificial Sequence
  Description of Artificial Sequence: Synthetic peptide
  Seed: ITGSLGPLLDGTATLRLVKRQVPL (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVKRQVPL

SEQ ID NO: 329547 - protein, 24 aa, Artificial Sequence
  Description of Artificial Sequence: Synthetic peptide
  Seed: ITGSLGPLLDGTATLRLVKRQVPL (PMEL_HUMAN)
  Core: DGTATLRLV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLXGTXTXRLXKRQVPL

SEQ ID NO: 329548 - protein, 24 aa, Artificial Sequence
  Description of Artificial Sequence: Synthetic peptide
  Seed: ITGSLGPLLDGTATLRLVKRQVPL (PMEL_HUMAN)
  Core: LRLVKRQVP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLDGTATXRLXKXQVXL

SEQ ID NO: 329549 - protein, 25 aa, Artificial Sequence
  Description of Artificial Sequence: Synthetic peptide
  Seed: ITGSLGPLLDGTATLRLVKRQVPLD (PMEL_HUMAN)
  Core: LDGTATLRL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLXDGXAXLRXVKRQVPLD

SEQ ID NO: 329550 - protein, 25 aa, Artificial Sequence
  Description of Artificial Sequence: Synthetic peptide
  Seed: ITGSLGPLLDGTATLRLVKRQVPLD (PMEL_HUMAN)
  Core: DGTATLRLV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLXGTXTXRLXKRQVPLD

SEQ ID NO: 329551 - protein, 25 aa, Artificial Sequence
  Description of Artificial Sequence: Synthetic peptide
  Seed: ITGSLGPLLDGTATLRLVKRQVPLD (PMEL_HUMAN)
  Core: TLRLVKRQV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLDGTAXLRXVXRQXPLD

SEQ ID NO: 329552 - protein, 25 aa, Artificial Sequence
  Description of Artificial Sequence: Synthetic peptide
  Seed: ITGSLGPLLDGTATLRLVKRQVPLD (PMEL_HUMAN)
  Core: LRLVKRQVP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ITGSLGPLLDGTATXRLXKXQVXLD

SEQ ID NO: 329553 - protein, 15 aa, Artificial Sequence
  Description of Artificial Sequence: Synthetic peptide
  Seed: IVGILLVLMAVVLAS (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXAS

SEQ ID NO: 329554 - protein, 15 aa, Artificial Sequence
  Description of Artificial Sequence: Synthetic peptide
  Seed: IVGILLVLMAVVLAS (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXS

SEQ ID NO: 329555 - protein, 16 aa, Artificial Sequence
  Description of Artificial Sequence: Synthetic peptide
  Seed: IVGILLVLMAVVLASL (PMEL_HUMAN)
  Core: ILLVLMAVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVGXLLXLXAVXLASL

SEQ ID NO: 329556 - protein, 16 aa, Artificial Sequence
  Description of Artificial Sequence: Synthetic peptide
  Seed: IVGILLVLMAVVLASL (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASL

SEQ ID NO: 329557 - protein, 16 aa, Artificial Sequence
  Description of Artificial Sequence: Synthetic peptide
  Seed: IVGILLVLMAVVLASL (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSL

SEQ ID NO: 329558 - protein, 17 aa, Artificial Sequence
  Description of Artificial Sequence: Synthetic peptide
  Seed: IVGILLVLMAVVLASLI (PMEL_HUMAN)
  Core: ILLVLMAVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVGXLLXLXAVXLASLI

SEQ ID NO: 329559 - protein, 17 aa, Artificial Sequence
  Description of Artificial Sequence: Synthetic peptide
  Seed: IVGILLVLMAVVLASLI (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLI

SEQ ID NO: 329560 - protein, 17 aa, Artificial Sequence
  Description of Artificial Sequence: Synthetic peptide
  Seed: IVGILLVLMAVVLASLI (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLI

SEQ ID NO: 329561 - protein, 17 aa, Artificial Sequence
  Description of Artificial Sequence: Synthetic peptide
  Seed: IVGILLVLMAVVLASLI (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLI

SEQ ID NO: 329562 - protein, 17 aa, Artificial Sequence
  Description of Artificial Sequence: Synthetic peptide
  Seed: IVGILLVLMAVVLASLI (PMEL_HUMAN)
  Core: LMAVVLASL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVXMAXVXASXI

SEQ ID NO: 329563 - protein, 17 aa, Artificial Sequence
  Description of Artificial Sequence: Synthetic peptide
  Seed: IVGILLVLMAVVLASLI (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLX

SEQ ID NO: 329564 - protein, 18 aa, Artificial Sequence
  Description of Artificial Sequence: Synthetic peptide
  Seed: IVGILLVLMAVVLASLIY (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIY

SEQ ID NO: 329565 - protein, 19 aa, Artificial Sequence
  Description of Artificial Sequence: Synthetic peptide
  Seed: IVGILLVLMAVVLASLIYR (PMEL_HUMAN)
  Core: ILLVLMAVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVGXLLXLXAVXLASLIYR

SEQ ID NO: 329566 - protein, 19 aa, Artificial Sequence
  Description of Artificial Sequence: Synthetic peptide
  Seed: IVGILLVLMAVVLASLIYR (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYR

SEQ ID NO: 329567 - protein, 19 aa, Artificial Sequence
  Description of Artificial Sequence: Synthetic peptide
  Seed: IVGILLVLMAVVLASLIYR (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYR

SEQ ID NO: 329568 - protein, 19 aa, Artificial Sequence
  Description of Artificial Sequence: Synthetic peptide
  Seed: IVGILLVLMAVVLASLIYR (PMEL_HUMAN)
  Core: LMAVVLASL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVXMAXVXASXIYR

SEQ ID NO: 329569 - protein, 19 aa, Artificial Sequence
  Description of Artificial Sequence: Synthetic peptide
  Seed: IVGILLVLMAVVLASLIYR (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLXYR

SEQ ID NO: 329570 - protein, 20 aa, Artificial Sequence
  Description of Artificial Sequence: Synthetic peptide
  Seed: IVGILLVLMAVVLASLIYRR (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYRR

SEQ ID NO: 329571 - protein, 20 aa, Artificial Sequence
  Description of Artificial Sequence: Synthetic peptide
  Seed: IVGILLVLMAVVLASLIYRR (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLIYRR

SEQ ID NO: 329572 - protein, 20 aa, Artificial Sequence
  Description of Artificial Sequence: Synthetic peptide
  Seed: IVGILLVLMAVVLASLIYRR (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYRR

SEQ ID NO: 329573 - protein, 20 aa, Artificial Sequence
  Description of Artificial Sequence: Synthetic peptide
  Seed: IVGILLVLMAVVLASLIYRR (PMEL_HUMAN)
  Core: LMAVVLASL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVXMAXVXASXIYRR

SEQ ID NO: 329574 - protein, 20 aa, Artificial Sequence
  Description of Artificial Sequence: Synthetic peptide
  Seed: IVGILLVLMAVVLASLIYRR (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLXYRR

SEQ ID NO: 329575 - protein, 20 aa, Artificial Sequence
  Description of Artificial Sequence: Synthetic peptide
  Seed: IVGILLVLMAVVLASLIYRR (PMEL_HUMAN)
  Core: AVVLASLIY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMXVVXAXLIXRR

SEQ ID NO: 329576 - protein, 20 aa, Artificial Sequence
  Description of Artificial Sequence: Synthetic peptide
  Seed: IVGILLVLMAVVLASLIYRR (PMEL_HUMAN)
  Core: VVLASLIYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAXVLXSXIYXR

SEQ ID NO: 329577 - protein, 20 aa, Artificial Sequence
  Description of Artificial Sequence: Synthetic peptide
  Seed: IVGILLVLMAVVLASLIYRR (PMEL_HUMAN)
  Core: VLASLIYRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVXLAXLXYRX

SEQ ID NO: 329578 - protein, 21 aa, Artificial Sequence
  Description of Artificial Sequence: Synthetic peptide
  Seed: IVGILLVLMAVVLASLIYRRR (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYRRR

SEQ ID NO: 329579 - protein, 21 aa, Artificial Sequence
  Description of Artificial Sequence: Synthetic peptide
  Seed: IVGILLVLMAVVLASLIYRRR (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLIYRRR

SEQ ID NO: 329580 - protein, 21 aa, Artificial Sequence
  Description of Artificial Sequence: Synthetic peptide
  Seed: IVGILLVLMAVVLASLIYRRR (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYRRR

SEQ ID NO: 329581 - protein, 21 aa, Artificial Sequence
  Description of Artificial Sequence: Synthetic peptide
  Seed: IVGILLVLMAVVLASLIYRRR (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLXYRRR

SEQ ID NO: 329582 - protein, 21 aa, Artificial Sequence
  Description of Artificial Sequence: Synthetic peptide
  Seed: IVGILLVLMAVVLASLIYRRR (PMEL_HUMAN)
  Core: AVVLASLIY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMXVVXAXLIXRRR

SEQ ID NO: 329583 - protein, 21 aa, Artificial Sequence
  Description of Artificial Sequence: Synthetic peptide
  Seed: IVGILLVLMAVVLASLIYRRR (PMEL_HUMAN)
  Core: VVLASLIYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAXVLXSXIYXRR

SEQ ID NO: 329584 - protein, 21 aa, Artificial Sequence
  Description of Artificial Sequence: Synthetic peptide
  Seed: IVGILLVLMAVVLASLIYRRR (PMEL_HUMAN)
  Core: VLASLIYRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVXLAXLXYRXR

SEQ ID NO: 329585 - protein, 21 aa, Artificial Sequence
  Description of Artificial Sequence: Synthetic peptide
  Seed: IVGILLVLMAVVLASLIYRRR (PMEL_HUMAN)
  Core: LASLIYRRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVXASXIXRRX

SEQ ID NO: 329586 - protein, 22 aa, Artificial Sequence
  Description of Artificial Sequence: Synthetic peptide
  Seed: IVGILLVLMAVVLASLIYRRRL (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYRRRL

SEQ ID NO: 329587 - protein, 22 aa, Artificial Sequence
  Description of Artificial Sequence: Synthetic peptide
  Seed: IVGILLVLMAVVLASLIYRRRL (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLIYRRRL

SEQ ID NO: 329588 - protein, 22 aa, Artificial Sequence
  Description of Artificial Sequence: Synthetic peptide
  Seed: IVGILLVLMAVVLASLIYRRRL (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYRRRL

SEQ ID NO: 329589 - protein, 22 aa, Artificial Sequence
  Description of Artificial Sequence: Synthetic peptide
  Seed: IVGILLVLMAVVLASLIYRRRL (PMEL_HUMAN)
  Core: VVLASLIYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAXVLXSXIYXRRL

SEQ ID NO: 329590 - protein, 22 aa, Artificial Sequence
  Description of Artificial Sequence: Synthetic peptide
  Seed: IVGILLVLMAVVLASLIYRRRL (PMEL_HUMAN)
  Core: VLASLIYRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVXLAXLXYRXRL

SEQ ID NO: 329591 - protein, 22 aa, Artificial Sequence
  Description of Artificial Sequence: Synthetic peptide
  Seed: IVGILLVLMAVVLASLIYRRRL (PMEL_HUMAN)
  Core: LASLIYRRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVXASXIXRRXL

SEQ ID NO: 329592 - protein, 23 aa, Artificial Sequence
  Description of Artificial Sequence: Synthetic peptide
  Seed: IVGILLVLMAVVLASLIYRRRLM (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYRRRLM

SEQ ID NO: 329593 - protein, 23 aa, Artificial Sequence
  Description of Artificial Sequence: Synthetic peptide
  Seed: IVGILLVLMAVVLASLIYRRRLM (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLIYRRRLM

SEQ ID NO: 329594 - protein, 23 aa, Artificial Sequence
  Description of Artificial Sequence: Synthetic peptide
  Seed: IVGILLVLMAVVLASLIYRRRLM (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYRRRLM

SEQ ID NO: 329595 - protein, 23 aa, Artificial Sequence
  Description of Artificial Sequence: Synthetic peptide
  Seed: IVGILLVLMAVVLASLIYRRRLM (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLXYRRRLM

SEQ ID NO: 329596 - protein, 23 aa, Artificial Sequence
  Description of Artificial Sequence: Synthetic peptide
  Seed: IVGILLVLMAVVLASLIYRRRLM (PMEL_HUMAN)
  Core: AVVLASLIY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMXVVXAXLIXRRRLM

SEQ ID NO: 329597 - protein, 23 aa, Artificial Sequence
  Description of Artificial Sequence: Synthetic peptide
  Seed: IVGILLVLMAVVLASLIYRRRLM (PMEL_HUMAN)
  Core: VVLASLIYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAXVLXSXIYXRRLM

SEQ ID NO: 329598 - protein, 23 aa, Artificial Sequence
  Description of Artificial Sequence: Synthetic peptide
  Seed: IVGILLVLMAVVLASLIYRRRLM (PMEL_HUMAN)
  Core: VLASLIYRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVXLAXLXYRXRLM

SEQ ID NO: 329599 - protein, 23 aa, Artificial Sequence
  Description of Artificial Sequence: Synthetic peptide
  Seed: IVGILLVLMAVVLASLIYRRRLM (PMEL_HUMAN)
  Core: LASLIYRRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVXASXIXRRXLM

SEQ ID NO: 329600 - protein, 24 aa, Artificial Sequence
  Description of Artificial Sequence: Synthetic peptide
  Seed: IVGILLVLMAVVLASLIYRRRLMK (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYRRRLMK

SEQ ID NO: 329601 - protein, 24 aa, Artificial Sequence
  Description of Artificial Sequence: Synthetic peptide
  Seed: IVGILLVLMAVVLASLIYRRRLMK (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLIYRRRLMK

SEQ ID NO: 329602 - protein, 24 aa, Artificial Sequence
  Description of Artificial Sequence: Synthetic peptide
  Seed: IVGILLVLMAVVLASLIYRRRLMK (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYRRRLMK

SEQ ID NO: 329603 - protein, 24 aa, Artificial Sequence
  Description of Artificial Sequence: Synthetic peptide
  Seed: IVGILLVLMAVVLASLIYRRRLMK (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLXYRRRLMK

SEQ ID NO: 329604 - protein, 24 aa, Artificial Sequence
  Description of Artificial Sequence: Synthetic peptide
  Seed: IVGILLVLMAVVLASLIYRRRLMK (PMEL_HUMAN)
  Core: AVVLASLIY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMXVVXAXLIXRRRLMK

SEQ ID NO: 329605 - protein, 24 aa, Artificial Sequence
  Description of Artificial Sequence: Synthetic peptide
  Seed: IVGILLVLMAVVLASLIYRRRLMK (PMEL_HUMAN)
  Core: VVLASLIYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAXVLXSXIYXRRLMK

SEQ ID NO: 329606 - protein, 24 aa, Artificial Sequence
  Description of Artificial Sequence: Synthetic peptide
  Seed: IVGILLVLMAVVLASLIYRRRLMK (PMEL_HUMAN)
  Core: VLASLIYRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVXLAXLXYRXRLMK

SEQ ID NO: 329607 - protein, 24 aa, Artificial Sequence
  Description of Artificial Sequence: Synthetic peptide
  Seed: IVGILLVLMAVVLASLIYRRRLMK (PMEL_HUMAN)
  Core: LASLIYRRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVXASXIXRRXLMK

SEQ ID NO: 329608 - protein, 25 aa, Artificial Sequence
  Description of Artificial Sequence: Synthetic peptide
  Seed: IVGILLVLMAVVLASLIYRRRLMKQ (PMEL_HUMAN)
  Core: LLVLMAVVL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVGIXLVXMXVVXASLIYRRRLMKQ

SEQ ID NO: 329609 - protein, 25 aa, Artificial Sequence
  Description of Artificial Sequence: Synthetic peptide
  Seed: IVGILLVLMAVVLASLIYRRRLMKQ (PMEL_HUMAN)
  Core: LVLMAVVLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVGILXVLXAXVLXSLIYRRRLMKQ

SEQ ID NO: 329610 - protein, 25 aa, Artificial Sequence
  Description of Artificial Sequence: Synthetic peptide
  Seed: IVGILLVLMAVVLASLIYRRRLMKQ (PMEL_HUMAN)
  Core: VLMAVVLAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLXLMXVXLAXLIYRRRLMKQ

SEQ ID NO: 329611 - protein, 25 aa, Artificial Sequence
  Description of Artificial Sequence: Synthetic peptide
  Seed: IVGILLVLMAVVLASLIYRRRLMKQ (PMEL_HUMAN)
  Core: MAVVLASLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLXAVXLXSLXYRRRLMKQ

SEQ ID NO: 329612 - protein, 25 aa, Artificial Sequence
  Description of Artificial Sequence: Synthetic peptide
  Seed: IVGILLVLMAVVLASLIYRRRLMKQ (PMEL_HUMAN)
  Core: AVVLASLIY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMXVVXAXLIXRRRLMKQ

SEQ ID NO: 329613 - protein, 25 aa, Artificial Sequence
  Description of Artificial Sequence: Synthetic peptide
  Seed: IVGILLVLMAVVLASLIYRRRLMKQ (PMEL_HUMAN)
  Core: VVLASLIYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAXVLXSXIYXRRLMKQ

SEQ ID NO: 329614 - protein, 25 aa, Artificial Sequence
  Description of Artificial Sequence: Synthetic peptide
  Seed: IVGILLVLMAVVLASLIYRRRLMKQ (PMEL_HUMAN)
  Core: VLASLIYRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVXLAXLXYRXRLMKQ

SEQ ID NO: 329615 - protein, 25 aa, Artificial Sequence
  Description of Artificial Sequence: Synthetic peptide
  Seed: IVGILLVLMAVVLASLIYRRRLMKQ (PMEL_HUMAN)
  Core: LASLIYRRR
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVXASXIXRRXLMKQ

SEQ ID NO: 329616 - protein, 25 aa, Artificial Sequence
  Description of Artificial Sequence: Synthetic peptide
  Seed: IVGILLVLMAVVLASLIYRRRLMKQ (PMEL_HUMAN)
  Core: ASLIYRRRL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVLXSLXYXRRXMKQ

SEQ ID NO: 329617 - protein, 25 aa, Artificial Sequence
  Description of Artificial Sequence: Synthetic peptide
  Seed: IVGILLVLMAVVLASLIYRRRLMKQ (PMEL_HUMAN)
  Core: SLIYRRRLM
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVLAXLIXRXRLXKQ

SEQ ID NO: 329618 - protein, 25 aa, Artificial Sequence
  Description of Artificial Sequence: Synthetic peptide
  Seed: IVGILLVLMAVVLASLIYRRRLMKQ (PMEL_HUMAN)
  Core: LIYRRRLMK
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
IVGILLVLMAVVLASXIYXRXLMXQ

SEQ ID NO: 329619 - protein, 13 aa, Artificial Sequence
  Description of Artificial Sequence: Synthetic peptide
  Seed: IVQGIESAEILQA (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQX

SEQ ID NO: 329620 - protein, 14 aa, Artificial Sequence
  Description of Artificial Sequence: Synthetic peptide
  Seed: IVQGIESAEILQAV (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXV

SEQ ID NO: 329621 - protein, 15 aa, Artificial Sequence
  Description of Artificial Sequence: Synthetic peptide
  Seed: IVQGIESAEILQAVP (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVP

SEQ ID NO: 329622 - protein, 16 aa, Artificial Sequence
  Description of Artificial Sequence: Synthetic peptide
  Seed: IVQGIESAEILQAVPS (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPS

SEQ ID NO: 329623 - protein, 17 aa, Artificial Sequence
  Description of Artificial Sequence: Synthetic peptide
  Seed: IVQGIESAEILQAVPSG (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSG

SEQ ID NO: 329624 - protein, 17 aa, Artificial Sequence
  Description of Artificial Sequence: Synthetic peptide
  Seed: IVQGIESAEILQAVPSG (PMEL_HUMAN)
  Core: ESAEILQAV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIXSAXIXQAXPSG

SEQ ID NO: 329625 - protein, 18 aa, Artificial Sequence
  Description of Artificial Sequence: Synthetic peptide
  Seed: IVQGIESAEILQAVPSGE (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGE

SEQ ID NO: 329626 - protein, 19 aa, Artificial Sequence
  Description of Artificial Sequence: Synthetic peptide
  Seed: IVQGIESAEILQAVPSGEG (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEG

SEQ ID NO: 329627 - protein, 19 aa, Artificial Sequence
  Description of Artificial Sequence: Synthetic peptide
  Seed: IVQGIESAEILQAVPSGEG (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEG

SEQ ID NO: 329628 - protein, 20 aa, Artificial Sequence
  Description of Artificial Sequence: Synthetic peptide
  Seed: IVQGIESAEILQAVPSGEGD (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEGD

SEQ ID NO: 329629 - protein, 20 aa, Artificial Sequence
  Description of Artificial Sequence: Synthetic peptide
  Seed: IVQGIESAEILQAVPSGEGD (PMEL_HUMAN)
  Core: ESAEILQAV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIXSAXIXQAXPSGEGD

SEQ ID NO: 329630 - protein, 20 aa, Artificial Sequence
  Description of Artificial Sequence: Synthetic peptide
  Seed: IVQGIESAEILQAVPSGEGD (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEGD

SEQ ID NO: 329631 - protein, 21 aa, Artificial Sequence
  Description of Artificial Sequence: Synthetic peptide
  Seed: IVQGIESAEILQAVPSGEGDA (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEGDA

SEQ ID NO: 329632 - protein, 21 aa, Artificial Sequence
  Description of Artificial Sequence: Synthetic peptide
  Seed: IVQGIESAEILQAVPSGEGDA (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEGDA

SEQ ID NO: 329633 - protein, 21 aa, Artificial Sequence
  Description of Artificial Sequence: Synthetic peptide
  Seed: IVQGIESAEILQAVPSGEGDA (PMEL_HUMAN)
  Core: LQAVPSGEG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESAEIXQAXPXGEXDA

SEQ ID NO: 329634 - protein, 22 aa, Artificial Sequence
  Description of Artificial Sequence: Synthetic peptide
  Seed: IVQGIESAEILQAVPSGEGDAF (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEGDAF

SEQ ID NO: 329635 - protein, 22 aa, Artificial Sequence
  Description of Artificial Sequence: Synthetic peptide
  Seed: IVQGIESAEILQAVPSGEGDAF (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEGDAF

SEQ ID NO: 329636 - protein, 22 aa, Artificial Sequence
  Description of Artificial Sequence: Synthetic peptide
  Seed: IVQGIESAEILQAVPSGEGDAF (PMEL_HUMAN)
  Core: LQAVPSGEG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESAEIXQAXPXGEXDAF

SEQ ID NO: 329637 - protein, 23 aa, Artificial Sequence
  Description of Artificial Sequence: Synthetic peptide
  Seed: IVQGIESAEILQAVPSGEGDAFE (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEGDAFE

SEQ ID NO: 329638 - protein, 23 aa, Artificial Sequence
  Description of Artificial Sequence: Synthetic peptide
  Seed: IVQGIESAEILQAVPSGEGDAFE (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEGDAFE

SEQ ID NO: 329639 - protein, 23 aa, Artificial Sequence
  Description of Artificial Sequence: Synthetic peptide
  Seed: IVQGIESAEILQAVPSGEGDAFE (PMEL_HUMAN)
  Core: LQAVPSGEG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESAEIXQAXPXGEXDAFE

SEQ ID NO: 329640 - protein, 24 aa, Artificial Sequence
  Description of Artificial Sequence: Synthetic peptide
  Seed: IVQGIESAEILQAVPSGEGDAFEL (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEGDAFEL

SEQ ID NO: 329641 - protein, 24 aa, Artificial Sequence
  Description of Artificial Sequence: Synthetic peptide
  Seed: IVQGIESAEILQAVPSGEGDAFEL (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEGDAFEL

SEQ ID NO: 329642 - protein, 24 aa, Artificial Sequence
  Description of Artificial Sequence: Synthetic peptide
  Seed: IVQGIESAEILQAVPSGEGDAFEL (PMEL_HUMAN)
  Core: LQAVPSGEG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESAEIXQAXPXGEXDAFEL

SEQ ID NO: 329643 - protein, 25 aa, Artificial Sequence
  Description of Artificial Sequence: Synthetic peptide
  Seed: IVQGIESAEILQAVPSGEGDAFELT (PMEL_HUMAN)
  Core: IESAEILQA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IVQGXESXEXLQXVPSGEGDAFELT

SEQ ID NO: 329644 - protein, 25 aa, Artificial Sequence
  Description of Artificial Sequence: Synthetic peptide
  Seed: IVQGIESAEILQAVPSGEGDAFELT (PMEL_HUMAN)
  Core: AEILQAVPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESXEIXQXVPXGEGDAFELT

SEQ ID NO: 329645 - protein, 25 aa, Artificial Sequence
  Description of Artificial Sequence: Synthetic peptide
  Seed: IVQGIESAEILQAVPSGEGDAFELT (PMEL_HUMAN)
  Core: LQAVPSGEG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVQGIESAEIXQAXPXGEXDAFELT

SEQ ID NO: 329646 - protein, 13 aa, Artificial Sequence
  Description of Artificial Sequence: Synthetic peptide
  Seed: IVVLSGTTAAQVT (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVT

SEQ ID NO: 329647 - protein, 13 aa, Artificial Sequence
  Description of Artificial Sequence: Synthetic peptide
  Seed: IVVLSGTTAAQVT (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXT

SEQ ID NO: 329648 - protein, 14 aa, Artificial Sequence
  Description of Artificial Sequence: Synthetic peptide
  Seed: IVVLSGTTAAQVTT (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTT

SEQ ID NO: 329649 - protein, 14 aa, Artificial Sequence
  Description of Artificial Sequence: Synthetic peptide
  Seed: IVVLSGTTAAQVTT (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTT

SEQ ID NO: 329650 - protein, 15 aa, Artificial Sequence
  Description of Artificial Sequence: Synthetic peptide
  Seed: IVVLSGTTAAQVTTT (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTTT

SEQ ID NO: 329651 - protein, 15 aa, Artificial Sequence
  Description of Artificial Sequence: Synthetic peptide
  Seed: IVVLSGTTAAQVTTT (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTT

SEQ ID NO: 329652 - protein, 16 aa, Artificial Sequence
  Description of Artificial Sequence: Synthetic peptide
  Seed: IVVLSGTTAAQVTTTE (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTTTE

SEQ ID NO: 329653 - protein, 16 aa, Artificial Sequence
  Description of Artificial Sequence: Synthetic peptide
  Seed: IVVLSGTTAAQVTTTE (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTE

SEQ ID NO: 329654 - protein, 16 aa, Artificial Sequence
  Description of Artificial Sequence: Synthetic peptide
  Seed: IVVLSGTTAAQVTTTE (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXE

SEQ ID NO: 329655 - protein, 17 aa, Artificial Sequence
  Description of Artificial Sequence: Synthetic peptide
  Seed: IVVLSGTTAAQVTTTEW (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTTTEW

SEQ ID NO: 329656 - protein, 17 aa, Artificial Sequence
  Description of Artificial Sequence: Synthetic peptide
  Seed: IVVLSGTTAAQVTTTEW (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEW

SEQ ID NO: 329657 - protein, 17 aa, Artificial Sequence
  Description of Artificial Sequence: Synthetic peptide
  Seed: IVVLSGTTAAQVTTTEW (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEW

SEQ ID NO: 329658 - protein, 18 aa, Artificial Sequence
  Description of Artificial Sequence: Synthetic peptide
  Seed: IVVLSGTTAAQVTTTEWV (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWV

SEQ ID NO: 329659 - protein, 18 aa, Artificial Sequence
  Description of Artificial Sequence: Synthetic peptide
  Seed: IVVLSGTTAAQVTTTEWV (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWV

SEQ ID NO: 329660 - protein, 19 aa, Artificial Sequence
  Description of Artificial Sequence: Synthetic peptide
  Seed: IVVLSGTTAAQVTTTEWVE (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTTTEWVE

SEQ ID NO: 329661 - protein, 19 aa, Artificial Sequence
  Description of Artificial Sequence: Synthetic peptide
  Seed: IVVLSGTTAAQVTTTEWVE (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVE

SEQ ID NO: 329662 - protein, 19 aa, Artificial Sequence
  Description of Artificial Sequence: Synthetic peptide
  Seed: IVVLSGTTAAQVTTTEWVE (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVE

SEQ ID NO: 329663 - protein, 20 aa, Artificial Sequence
  Description of Artificial Sequence: Synthetic peptide
  Seed: IVVLSGTTAAQVTTTEWVET (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTTTEWVET

SEQ ID NO: 329664 - protein, 20 aa, Artificial Sequence
  Description of Artificial Sequence: Synthetic peptide
  Seed: IVVLSGTTAAQVTTTEWVET (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVET

SEQ ID NO: 329665 - protein, 20 aa, Artificial Sequence
  Description of Artificial Sequence: Synthetic peptide
  Seed: IVVLSGTTAAQVTTTEWVET (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVET

SEQ ID NO: 329666 - protein, 21 aa, Artificial Sequence
  Description of Artificial Sequence: Synthetic peptide
  Seed: IVVLSGTTAAQVTTTEWVETT (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVETT

SEQ ID NO: 329667 - protein, 21 aa, Artificial Sequence
  Description of Artificial Sequence: Synthetic peptide
  Seed: IVVLSGTTAAQVTTTEWVETT (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVETT

SEQ ID NO: 329668 - protein, 21 aa, Artificial Sequence
  Description of Artificial Sequence: Synthetic peptide
  Seed: IVVLSGTTAAQVTTTEWVETT (PMEL_HUMAN)
  Core: VTTTEWVET
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQXTTXEXVEXT

SEQ ID NO: 329669 - protein, 22 aa, Artificial Sequence
  Description of Artificial Sequence: Synthetic peptide
  Seed: IVVLSGTTAAQVTTTEWVETTA (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVETTA

SEQ ID NO: 329670 - protein, 22 aa, Artificial Sequence
  Description of Artificial Sequence: Synthetic peptide
  Seed: IVVLSGTTAAQVTTTEWVETTA (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVETTA

SEQ ID NO: 329671 - protein, 22 aa, Artificial Sequence
  Description of Artificial Sequence: Synthetic peptide
  Seed: IVVLSGTTAAQVTTTEWVETTA (PMEL_HUMAN)
  Core: VTTTEWVET
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQXTTXEXVEXTA

SEQ ID NO: 329672 - protein, 23 aa, Artificial Sequence
  Description of Artificial Sequence: Synthetic peptide
  Seed: IVVLSGTTAAQVTTTEWVETTAR (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVETTAR

SEQ ID NO: 329673 - protein, 23 aa, Artificial Sequence
  Description of Artificial Sequence: Synthetic peptide
  Seed: IVVLSGTTAAQVTTTEWVETTAR (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVETTAR

SEQ ID NO: 329674 - protein, 23 aa, Artificial Sequence
  Description of Artificial Sequence: Synthetic peptide
  Seed: IVVLSGTTAAQVTTTEWVETTAR (PMEL_HUMAN)
  Core: VTTTEWVET
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQXTTXEXVEXTAR

SEQ ID NO: 329675 - protein, 24 aa, Artificial Sequence
  Description of Artificial Sequence: Synthetic peptide
  Seed: IVVLSGTTAAQVTTTEWVETTARE (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVETTARE

SEQ ID NO: 329676 - protein, 24 aa, Artificial Sequence
  Description of Artificial Sequence: Synthetic peptide
  Seed: IVVLSGTTAAQVTTTEWVETTARE (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVETTARE

SEQ ID NO: 329677 - protein, 24 aa, Artificial Sequence
  Description of Artificial Sequence: Synthetic peptide
  Seed: IVVLSGTTAAQVTTTEWVETTARE (PMEL_HUMAN)
  Core: QVTTTEWVE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAXVTXTXWVXTTARE

SEQ ID NO: 329678 - protein, 24 aa, Artificial Sequence
  Description of Artificial Sequence: Synthetic peptide
  Seed: IVVLSGTTAAQVTTTEWVETTARE (PMEL_HUMAN)
  Core: VTTTEWVET
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQXTTXEXVEXTARE

SEQ ID NO: 329679 - protein, 24 aa, Artificial Sequence
  Description of Artificial Sequence: Synthetic peptide
  Seed: IVVLSGTTAAQVTTTEWVETTARE (PMEL_HUMAN)
  Core: TTTEWVETT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQVXTTXWXETXARE

SEQ ID NO: 329680 - protein, 24 aa, Artificial Sequence
  Description of Artificial Sequence: Synthetic peptide
  Seed: IVVLSGTTAAQVTTTEWVETTARE (PMEL_HUMAN)
  Core: TTEWVETTA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQVTXTEXVXTTXRE

SEQ ID NO: 329681 - protein, 25 aa, Artificial Sequence
  Description of Artificial Sequence: Synthetic peptide
  Seed: IVVLSGTTAAQVTTTEWVETTAREL (PMEL_HUMAN)
  Core: VLSGTTAAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IVXLSXTXAAXVTTTEWVETTAREL

SEQ ID NO: 329682 - protein, 25 aa, Artificial Sequence
  Description of Artificial Sequence: Synthetic peptide
  Seed: IVVLSGTTAAQVTTTEWVETTAREL (PMEL_HUMAN)
  Core: LSGTTAAQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IVVXSGXTXAQXTTTEWVETTAREL

SEQ ID NO: 329683 - protein, 25 aa, Artificial Sequence
  Description of Artificial Sequence: Synthetic peptide
  Seed: IVVLSGTTAAQVTTTEWVETTAREL (PMEL_HUMAN)
  Core: TTAAQVTTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGXTAXQXTTXEWVETTAREL

SEQ ID NO: 329684 - protein, 25 aa, Artificial Sequence
  Description of Artificial Sequence: Synthetic peptide
  Seed: IVVLSGTTAAQVTTTEWVETTAREL (PMEL_HUMAN)
  Core: QVTTTEWVE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAXVTXTXWVXTTAREL

SEQ ID NO: 329685 - protein, 25 aa, Artificial Sequence
  Description of Artificial Sequence: Synthetic peptide
  Seed: IVVLSGTTAAQVTTTEWVETTAREL (PMEL_HUMAN)
  Core: VTTTEWVET
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQXTTXEXVEXTAREL

SEQ ID NO: 329686 - protein, 25 aa, Artificial Sequence
  Description of Artificial Sequence: Synthetic peptide
  Seed: IVVLSGTTAAQVTTTEWVETTAREL (PMEL_HUMAN)
  Core: TTTEWVETT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQVXTTXWXETXAREL

SEQ ID NO: 329687 - protein, 25 aa, Artificial Sequence
  Description of Artificial Sequence: Synthetic peptide
  Seed: IVVLSGTTAAQVTTTEWVETTAREL (PMEL_HUMAN)
  Core: TTEWVETTA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQVTXTEXVXTTXREL

SEQ ID NO: 329688 - protein, 25 aa, Artificial Sequence
  Description of Artificial Sequence: Synthetic peptide
  Seed: IVVLSGTTAAQVTTTEWVETTAREL (PMEL_HUMAN)
  Core: WVETTAREL
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
IVVLSGTTAAQVTTTEXVEXTXREX

SEQ ID NO: 329689 - protein, 13 aa, Artificial Sequence
  Description of Artificial Sequence: Synthetic peptide
  Seed: IWVNNTIINGSQV (PMEL_HUMAN)
  Core: WVNNTIING
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXVNXTXINXSQV

SEQ ID NO: 329690 - protein, 14 aa, Artificial Sequence
  Description of Artificial Sequence: Synthetic peptide
  Seed: IWVNNTIINGSQVW (PMEL_HUMAN)
  Core: WVNNTIING
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXVNXTXINXSQVW

SEQ ID NO: 329691 - protein, 14 aa, Artificial Sequence
  Description of Artificial Sequence: Synthetic peptide
  Seed: IWVNNTIINGSQVW (PMEL_HUMAN)
  Core: VNNTIINGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IWXNNXIXNGXQVW

SEQ ID NO: 329692 - protein, 15 aa, Artificial Sequence
  Description of Artificial Sequence: Synthetic peptide
  Seed: IWVNNTIINGSQVWG (PMEL_HUMAN)
  Core: WVNNTIING
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXVNXTXINXSQVWG

SEQ ID NO: 329693 - protein, 15 aa, Artificial Sequence
  Description of Artificial Sequence: Synthetic peptide
  Seed: IWVNNTIINGSQVWG (PMEL_HUMAN)
  Core: VNNTIINGS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IWXNNXIXNGXQVWG

SEQ ID NO: 329694 - protein, 15 aa, Artificial Sequence
  Description of Artificial Sequence: Synthetic peptide
  Seed: IWVNNTIINGSQVWG (PMEL_HUMAN)
  Core: NNTIINGSQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IWVXNTXIXGSXVWG

SEQ ID NO: 329695 - protein, 15 aa, Artificial Sequence
  Description of Artificial Sequence: Synthetic peptide
  Seed: IWVNNTIINGSQVWG (PMEL_HUMAN)
  Core: NTIINGSQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IWVNXTIXNXSQXWG

SEQ ID NO: 329696 - protein, 16 aa, Artificial Sequence
  Description of Artificial Sequence: Synthetic peptide
  Seed: IWVNNTIINGSQVWGG (PMEL_HUMAN)
  Core: WVNNTIING
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
IXVNXTXINXSQVWGG

SEQ ID NO: 329697 - protein, 16 aa, Artificial Sequence
  Description of Artificial Sequence: Synthetic peptide
  Seed: IWVNNTIINGSQVWGG (PMEL_HUMAN)
  Core: NTIINGSQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IWVNXTIXNXSQXWGG

SEQ ID NO: 329698 - protein, 16 aa, Artificial Sequence
  Description of Artificial Sequence: Synthetic peptide
  Seed: IWVNNTIINGSQVWGG (PMEL_HUMAN)
  Core: TIINGSQVW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNXIIXGXQVXGG

SEQ ID NO: 329699 - protein, 16 aa, Artificial Sequence
  Description of Artificial Sequence: Synthetic peptide
  Seed: IWVNNTIINGSQVWGG (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGX

SEQ ID NO: 329700 - protein, 17 aa, Artificial Sequence
  Description of Artificial Sequence: Synthetic peptide
  Seed: IWVNNTIINGSQVWGGQ (PMEL_HUMAN)
  Core: TIINGSQVW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNXIIXGXQVXGGQ

SEQ ID NO: 329701 - protein, 17 aa, Artificial Sequence
  Description of Artificial Sequence: Synthetic peptide
  Seed: IWVNNTIINGSQVWGGQ (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQ

SEQ ID NO: 329702 - protein, 18 aa, Artificial Sequence
  Description of Artificial Sequence: Synthetic peptide
  Seed: IWVNNTIINGSQVWGGQP (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQP

SEQ ID NO: 329703 - protein, 19 aa, Artificial Sequence
  Description of Artificial Sequence: Synthetic peptide
  Seed: IWVNNTIINGSQVWGGQPV (PMEL_HUMAN)
  Core: TIINGSQVW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNXIIXGXQVXGGQPV

SEQ ID NO: 329704 - protein, 19 aa, Artificial Sequence
  Description of Artificial Sequence: Synthetic peptide
  Seed: IWVNNTIINGSQVWGGQPV (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPV

SEQ ID NO: 329705 - protein, 20 aa, Artificial Sequence
  Description of Artificial Sequence: Synthetic peptide
  Seed: IWVNNTIINGSQVWGGQPVY (PMEL_HUMAN)
  Core: TIINGSQVW
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNXIIXGXQVXGGQPVY

SEQ ID NO: 329706 - protein, 20 aa, Artificial Sequence
  Description of Artificial Sequence: Synthetic peptide
  Seed: IWVNNTIINGSQVWGGQPVY (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPVY

SEQ ID NO: 329707 - protein, 21 aa, Artificial Sequence
  Description of Artificial Sequence: Synthetic peptide
  Seed: IWVNNTIINGSQVWGGQPVYP (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPVYP

SEQ ID NO: 329708 - protein, 22 aa, Artificial Sequence
  Description of Artificial Sequence: Synthetic peptide
  Seed: IWVNNTIINGSQVWGGQPVYPQ (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPVYPQ

SEQ ID NO: 329709 - protein, 23 aa, Artificial Sequence
  Description of Artificial Sequence: Synthetic peptide
  Seed: IWVNNTIINGSQVWGGQPVYPQE (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPVYPQE

SEQ ID NO: 329710 - protein, 24 aa, Artificial Sequence
  Description of Artificial Sequence: Synthetic peptide
  Seed: IWVNNTIINGSQVWGGQPVYPQET (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPVYPQET

SEQ ID NO: 329711 - protein, 24 aa, Artificial Sequence
  Description of Artificial Sequence: Synthetic peptide
  Seed: IWVNNTIINGSQVWGGQPVYPQET (PMEL_HUMAN)
  Core: VWGGQPVYP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIINGSQXWGXQXVYXQET

SEQ ID NO: 329712 - protein, 25 aa, Artificial Sequence
  Description of Artificial Sequence: Synthetic peptide
  Seed: IWVNNTIINGSQVWGGQPVYPQETD (PMEL_HUMAN)
  Core: INGSQVWGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIXNGXQXWGXQPVYPQETD

SEQ ID NO: 329713 - protein, 25 aa, Artificial Sequence
  Description of Artificial Sequence: Synthetic peptide
  Seed: IWVNNTIINGSQVWGGQPVYPQETD (PMEL_HUMAN)
  Core: VWGGQPVYP
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
IWVNNTIINGSQXWGXQXVYXQETD

SEQ ID NO: 329714 - protein, 15 aa, Artificial Sequence
  Description of Artificial Sequence: Synthetic peptide
  Seed: IYRRRLMKQDFSVPQ (PMEL_HUMAN)
  Core: RRLMKQDFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IYRXRLXKXDFXVPQ

SEQ ID NO: 329715 - protein, 15 aa, Artificial Sequence
  Description of Artificial Sequence: Synthetic peptide
  Seed: IYRRRLMKQDFSVPQ (PMEL_HUMAN)
  Core: RLMKQDFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IYRRXLMXQXFSXPQ

SEQ ID NO: 329716 - protein, 15 aa, Artificial Sequence
  Description of Artificial Sequence: Synthetic peptide
  Seed: IYRRRLMKQDFSVPQ (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQ

SEQ ID NO: 329717 - protein, 15 aa, Artificial Sequence
  Description of Artificial Sequence: Synthetic peptide
  Seed: IYRRRLMKQDFSVPQ (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPX

SEQ ID NO: 329718 - protein, 16 aa, Artificial Sequence
  Description of Artificial Sequence: Synthetic peptide
  Seed: IYRRRLMKQDFSVPQL (PMEL_HUMAN)
  Core: RRLMKQDFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IYRXRLXKXDFXVPQL

SEQ ID NO: 329719 - protein, 16 aa, Artificial Sequence
  Description of Artificial Sequence: Synthetic peptide
  Seed: IYRRRLMKQDFSVPQL (PMEL_HUMAN)
  Core: RLMKQDFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IYRRXLMXQXFSXPQL

SEQ ID NO: 329720 - protein, 16 aa, Artificial Sequence
  Description of Artificial Sequence: Synthetic peptide
  Seed: IYRRRLMKQDFSVPQL (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQL

SEQ ID NO: 329721 - protein, 16 aa, Artificial Sequence
  Description of Artificial Sequence: Synthetic peptide
  Seed: IYRRRLMKQDFSVPQL (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXL

SEQ ID NO: 329722 - protein, 17 aa, Artificial Sequence
  Description of Artificial Sequence: Synthetic peptide
  Seed: IYRRRLMKQDFSVPQLP (PMEL_HUMAN)
  Core: RRLMKQDFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IYRXRLXKXDFXVPQLP

SEQ ID NO: 329723 - protein, 17 aa, Artificial Sequence
  Description of Artificial Sequence: Synthetic peptide
  Seed: IYRRRLMKQDFSVPQLP (PMEL_HUMAN)
  Core: RLMKQDFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IYRRXLMXQXFSXPQLP

SEQ ID NO: 329724 - protein, 17 aa, Artificial Sequence
  Description of Artificial Sequence: Synthetic peptide
  Seed: IYRRRLMKQDFSVPQLP (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLP

SEQ ID NO: 329725 - protein, 17 aa, Artificial Sequence
  Description of Artificial Sequence: Synthetic peptide
  Seed: IYRRRLMKQDFSVPQLP (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLP

SEQ ID NO: 329726 - protein, 18 aa, Artificial Sequence
  Description of Artificial Sequence: Synthetic peptide
  Seed: IYRRRLMKQDFSVPQLPH (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPH

SEQ ID NO: 329727 - protein, 19 aa, Artificial Sequence
  Description of Artificial Sequence: Synthetic peptide
  Seed: IYRRRLMKQDFSVPQLPHS (PMEL_HUMAN)
  Core: RRLMKQDFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IYRXRLXKXDFXVPQLPHS

SEQ ID NO: 329728 - protein, 19 aa, Artificial Sequence
  Description of Artificial Sequence: Synthetic peptide
  Seed: IYRRRLMKQDFSVPQLPHS (PMEL_HUMAN)
  Core: RLMKQDFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IYRRXLMXQXFSXPQLPHS

SEQ ID NO: 329729 - protein, 19 aa, Artificial Sequence
  Description of Artificial Sequence: Synthetic peptide
  Seed: IYRRRLMKQDFSVPQLPHS (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHS

SEQ ID NO: 329730 - protein, 19 aa, Artificial Sequence
  Description of Artificial Sequence: Synthetic peptide
  Seed: IYRRRLMKQDFSVPQLPHS (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHS

SEQ ID NO: 329731 - protein, 19 aa, Artificial Sequence
  Description of Artificial Sequence: Synthetic peptide
  Seed: IYRRRLMKQDFSVPQLPHS (PMEL_HUMAN)
  Core: KQDFSVPQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMXQDXSXPQXPHS

SEQ ID NO: 329732 - protein, 20 aa, Artificial Sequence
  Description of Artificial Sequence: Synthetic peptide
  Seed: IYRRRLMKQDFSVPQLPHSS (PMEL_HUMAN)
  Core: RRLMKQDFS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IYRXRLXKXDFXVPQLPHSS

SEQ ID NO: 329733 - protein, 20 aa, Artificial Sequence
  Description of Artificial Sequence: Synthetic peptide
  Seed: IYRRRLMKQDFSVPQLPHSS (PMEL_HUMAN)
  Core: RLMKQDFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IYRRXLMXQXFSXPQLPHSS

SEQ ID NO: 329734 - protein, 20 aa, Artificial Sequence
  Description of Artificial Sequence: Synthetic peptide
  Seed: IYRRRLMKQDFSVPQLPHSS (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHSS

SEQ ID NO: 329735 - protein, 20 aa, Artificial Sequence
  Description of Artificial Sequence: Synthetic peptide
  Seed: IYRRRLMKQDFSVPQLPHSS (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHSS

SEQ ID NO: 329736 - protein, 20 aa, Artificial Sequence
  Description of Artificial Sequence: Synthetic peptide
  Seed: IYRRRLMKQDFSVPQLPHSS (PMEL_HUMAN)
  Core: KQDFSVPQL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMXQDXSXPQXPHSS

SEQ ID NO: 329737 - protein, 20 aa, Artificial Sequence
  Description of Artificial Sequence: Synthetic peptide
  Seed: IYRRRLMKQDFSVPQLPHSS (PMEL_HUMAN)
  Core: FSVPQLPHS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMKQDXSVXQXPHXS

SEQ ID NO: 329738 - protein, 21 aa, Artificial Sequence
  Description of Artificial Sequence: Synthetic peptide
  Seed: IYRRRLMKQDFSVPQLPHSSS (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHSSS

SEQ ID NO: 329739 - protein, 21 aa, Artificial Sequence
  Description of Artificial Sequence: Synthetic peptide
  Seed: IYRRRLMKQDFSVPQLPHSSS (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHSSS

SEQ ID NO: 329740 - protein, 21 aa, Artificial Sequence
  Description of Artificial Sequence: Synthetic peptide
  Seed: IYRRRLMKQDFSVPQLPHSSS (PMEL_HUMAN)
  Core: FSVPQLPHS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMKQDXSVXQXPHXSS

SEQ ID NO: 329741 - protein, 22 aa, Artificial Sequence
  Description of Artificial Sequence: Synthetic peptide
  Seed: IYRRRLMKQDFSVPQLPHSSSH (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHSSSH

SEQ ID NO: 329742 - protein, 22 aa, Artificial Sequence
  Description of Artificial Sequence: Synthetic peptide
  Seed: IYRRRLMKQDFSVPQLPHSSSH (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHSSSH

SEQ ID NO: 329743 - protein, 22 aa, Artificial Sequence
  Description of Artificial Sequence: Synthetic peptide
  Seed: IYRRRLMKQDFSVPQLPHSSSH (PMEL_HUMAN)
  Core: FSVPQLPHS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMKQDXSVXQXPHXSSH

SEQ ID NO: 329744 - protein, 23 aa, Artificial Sequence
  Description of Artificial Sequence: Synthetic peptide
  Seed: IYRRRLMKQDFSVPQLPHSSSHW (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHSSSHW

SEQ ID NO: 329745 - protein, 23 aa, Artificial Sequence
  Description of Artificial Sequence: Synthetic peptide
  Seed: IYRRRLMKQDFSVPQLPHSSSHW (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHSSSHW

SEQ ID NO: 329746 - protein, 23 aa, Artificial Sequence
  Description of Artificial Sequence: Synthetic peptide
  Seed: IYRRRLMKQDFSVPQLPHSSSHW (PMEL_HUMAN)
  Core: FSVPQLPHS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMKQDXSVXQXPHXSSHW

SEQ ID NO: 329747 - protein, 24 aa, Artificial Sequence
  Description of Artificial Sequence: Synthetic peptide
  Seed: IYRRRLMKQDFSVPQLPHSSSHWL (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHSSSHWL

SEQ ID NO: 329748 - protein, 24 aa, Artificial Sequence
  Description of Artificial Sequence: Synthetic peptide
  Seed: IYRRRLMKQDFSVPQLPHSSSHWL (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHSSSHWL

SEQ ID NO: 329749 - protein, 24 aa, Artificial Sequence
  Description of Artificial Sequence: Synthetic peptide
  Seed: IYRRRLMKQDFSVPQLPHSSSHWL (PMEL_HUMAN)
  Core: FSVPQLPHS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMKQDXSVXQXPHXSSHWL

SEQ ID NO: 329750 - protein, 25 aa, Artificial Sequence
  Description of Artificial Sequence: Synthetic peptide
  Seed: IYRRRLMKQDFSVPQLPHSSSHWLR (PMEL_HUMAN)
  Core: LMKQDFSVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRXMKXDXSVXQLPHSSSHWLR

SEQ ID NO: 329751 - protein, 25 aa, Artificial Sequence
  Description of Artificial Sequence: Synthetic peptide
  Seed: IYRRRLMKQDFSVPQLPHSSSHWLR (PMEL_HUMAN)
  Core: MKQDFSVPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLXKQXFXVPXLPHSSSHWLR

SEQ ID NO: 329752 - protein, 25 aa, Artificial Sequence
  Description of Artificial Sequence: Synthetic peptide
  Seed: IYRRRLMKQDFSVPQLPHSSSHWLR (PMEL_HUMAN)
  Core: FSVPQLPHS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
IYRRRLMKQDXSVXQXPHXSSHWLR

SEQ ID NO: 329753 - protein, 17 aa, Artificial Sequence
  Description of Artificial Sequence: Synthetic peptide
  Seed: KAWNRQLYPEWTEAQRL (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRL

SEQ ID NO: 329754 - protein, 19 aa, Artificial Sequence
  Description of Artificial Sequence: Synthetic peptide
  Seed: KAWNRQLYPEWTEAQRLDC (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDC

SEQ ID NO: 329755 - protein, 20 aa, Artificial Sequence
  Description of Artificial Sequence: Synthetic peptide
  Seed: KAWNRQLYPEWTEAQRLDCW (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDCW

SEQ ID NO: 329756 - protein, 21 aa, Artificial Sequence
  Description of Artificial Sequence: Synthetic peptide
  Seed: KAWNRQLYPEWTEAQRLDCWR (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDCWR

SEQ ID NO: 329757 - protein, 22 aa, Artificial Sequence
  Description of Artificial Sequence: Synthetic peptide
  Seed: KAWNRQLYPEWTEAQRLDCWRG (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDCWRG

SEQ ID NO: 329758 - protein, 23 aa, Artificial Sequence
  Description of Artificial Sequence: Synthetic peptide
  Seed: KAWNRQLYPEWTEAQRLDCWRGG (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDCWRGG

SEQ ID NO: 329759 - protein, 24 aa, Artificial Sequence
  Description of Artificial Sequence: Synthetic peptide
  Seed: KAWNRQLYPEWTEAQRLDCWRGGQ (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDCWRGGQ

SEQ ID NO: 329760 - protein, 25 aa, Artificial Sequence
  Description of Artificial Sequence: Synthetic peptide
  Seed: KAWNRQLYPEWTEAQRLDCWRGGQV (PMEL_HUMAN)
  Core: LYPEWTEAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KAWNRQXYPXWXEAXRLDCWRGGQV

SEQ ID NO: 329761 - protein, 15 aa, Artificial Sequence
  Description of Artificial Sequence: Synthetic peptide
  Seed: KGGSGTYCLNVSLAD (PMEL_HUMAN)
  Core: SGTYCLNVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KGGXGTXCXNVXLAD

SEQ ID NO: 329762 - protein, 15 aa, Artificial Sequence
  Description of Artificial Sequence: Synthetic peptide
  Seed: KGGSGTYCLNVSLAD (PMEL_HUMAN)
  Core: TYCLNVSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGXYCXNXSLXD

SEQ ID NO: 329763 - protein, 15 aa, Artificial Sequence
  Description of Artificial Sequence: Synthetic peptide
  Seed: KGGSGTYCLNVSLAD (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAX

SEQ ID NO: 329764 - protein, 16 aa, Artificial Sequence
  Description of Artificial Sequence: Synthetic peptide
  Seed: KGGSGTYCLNVSLADT (PMEL_HUMAN)
  Core: SGTYCLNVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KGGXGTXCXNVXLADT

SEQ ID NO: 329765 - protein, 16 aa, Artificial Sequence
  Description of Artificial Sequence: Synthetic peptide
  Seed: KGGSGTYCLNVSLADT (PMEL_HUMAN)
  Core: TYCLNVSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGXYCXNXSLXDT

SEQ ID NO: 329766 - protein, 16 aa, Artificial Sequence
  Description of Artificial Sequence: Synthetic peptide
  Seed: KGGSGTYCLNVSLADT (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXT

SEQ ID NO: 329767 - protein, 17 aa, Artificial Sequence
  Description of Artificial Sequence: Synthetic peptide
  Seed: KGGSGTYCLNVSLADTN (PMEL_HUMAN)
  Core: SGTYCLNVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KGGXGTXCXNVXLADTN

SEQ ID NO: 329768 - protein, 17 aa, Artificial Sequence
  Description of Artificial Sequence: Synthetic peptide
  Seed: KGGSGTYCLNVSLADTN (PMEL_HUMAN)
  Core: TYCLNVSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGXYCXNXSLXDTN

SEQ ID NO: 329769 - protein, 17 aa, Artificial Sequence
  Description of Artificial Sequence: Synthetic peptide
  Seed: KGGSGTYCLNVSLADTN (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTN

SEQ ID NO: 329770 - protein, 19 aa, Artificial Sequence
  Description of Artificial Sequence: Synthetic peptide
  Seed: KGGSGTYCLNVSLADTNSL (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSL

SEQ ID NO: 329771 - protein, 20 aa, Artificial Sequence
  Description of Artificial Sequence: Synthetic peptide
  Seed: KGGSGTYCLNVSLADTNSLA (PMEL_HUMAN)
  Core: SGTYCLNVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KGGXGTXCXNVXLADTNSLA

SEQ ID NO: 329772 - protein, 20 aa, Artificial Sequence
  Description of Artificial Sequence: Synthetic peptide
  Seed: KGGSGTYCLNVSLADTNSLA (PMEL_HUMAN)
  Core: TYCLNVSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGXYCXNXSLXDTNSLA

SEQ ID NO: 329773 - protein, 20 aa, Artificial Sequence
  Description of Artificial Sequence: Synthetic peptide
  Seed: KGGSGTYCLNVSLADTNSLA (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSLA

SEQ ID NO: 329774 - protein, 21 aa, Artificial Sequence
  Description of Artificial Sequence: Synthetic peptide
  Seed: KGGSGTYCLNVSLADTNSLAV (PMEL_HUMAN)
  Core: TYCLNVSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGXYCXNXSLXDTNSLAV

SEQ ID NO: 329775 - protein, 21 aa, Artificial Sequence
  Description of Artificial Sequence: Synthetic peptide
  Seed: KGGSGTYCLNVSLADTNSLAV (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSLAV

SEQ ID NO: 329776 - protein, 21 aa, Artificial Sequence
  Description of Artificial Sequence: Synthetic peptide
  Seed: KGGSGTYCLNVSLADTNSLAV (PMEL_HUMAN)
  Core: VSLADTNSL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNXSLXDXNSXAV

SEQ ID NO: 329777 - protein, 21 aa, Artificial Sequence
  Description of Artificial Sequence: Synthetic peptide
  Seed: KGGSGTYCLNVSLADTNSLAV (PMEL_HUMAN)
  Core: LADTNSLAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNVSXADXNXLAX

SEQ ID NO: 329778 - protein, 22 aa, Artificial Sequence
  Description of Artificial Sequence: Synthetic peptide
  Seed: KGGSGTYCLNVSLADTNSLAVV (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSLAVV

SEQ ID NO: 329779 - protein, 22 aa, Artificial Sequence
  Description of Artificial Sequence: Synthetic peptide
  Seed: KGGSGTYCLNVSLADTNSLAVV (PMEL_HUMAN)
  Core: LADTNSLAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNVSXADXNXLAXV

SEQ ID NO: 329780 - protein, 23 aa, Artificial Sequence
  Description of Artificial Sequence: Synthetic peptide
  Seed: KGGSGTYCLNVSLADTNSLAVVS (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSLAVVS

SEQ ID NO: 329781 - protein, 23 aa, Artificial Sequence
  Description of Artificial Sequence: Synthetic peptide
  Seed: KGGSGTYCLNVSLADTNSLAVVS (PMEL_HUMAN)
  Core: LADTNSLAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNVSXADXNXLAXVS

SEQ ID NO: 329782 - protein, 24 aa, Artificial Sequence
  Description of Artificial Sequence: Synthetic peptide
  Seed: KGGSGTYCLNVSLADTNSLAVVST (PMEL_HUMAN)
  Core: TYCLNVSLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGXYCXNXSLXDTNSLAVVST

SEQ ID NO: 329783 - protein, 24 aa, Artificial Sequence
  Description of Artificial Sequence: Synthetic peptide
  Seed: KGGSGTYCLNVSLADTNSLAVVST (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSLAVVST

SEQ ID NO: 329784 - protein, 24 aa, Artificial Sequence
  Description of Artificial Sequence: Synthetic peptide
  Seed: KGGSGTYCLNVSLADTNSLAVVST (PMEL_HUMAN)
  Core: LADTNSLAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNVSXADXNXLAXVST

SEQ ID NO: 329785 - protein, 25 aa, Artificial Sequence
  Description of Artificial Sequence: Synthetic peptide
  Seed: KGGSGTYCLNVSLADTNSLAVVSTQ (PMEL_HUMAN)
  Core: YCLNVSLAD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTXCLXVXLAXTNSLAVVSTQ

SEQ ID NO: 329786 - protein, 25 aa, Artificial Sequence
  Description of Artificial Sequence: Synthetic peptide
  Seed: KGGSGTYCLNVSLADTNSLAVVSTQ (PMEL_HUMAN)
  Core: LADTNSLAV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNVSXADXNXLAXVSTQ

SEQ ID NO: 329787 - protein, 25 aa, Artificial Sequence
  Description of Artificial Sequence: Synthetic peptide
  Seed: KGGSGTYCLNVSLADTNSLAVVSTQ (PMEL_HUMAN)
  Core: DTNSLAVVS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KGGSGTYCLNVSLAXTNXLXVVXTQ

SEQ ID NO: 329788 - protein, 13 aa, Artificial Sequence
  Description of Artificial Sequence: Synthetic peptide
  Seed: KHFLRNQPLTFAL (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXAL

SEQ ID NO: 329789 - protein, 13 aa, Artificial Sequence
  Description of Artificial Sequence: Synthetic peptide
  Seed: KHFLRNQPLTFAL (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXL

SEQ ID NO: 329790 - protein, 14 aa, Artificial Sequence
  Description of Artificial Sequence: Synthetic peptide
  Seed: KHFLRNQPLTFALQ (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQ

SEQ ID NO: 329791 - protein, 14 aa, Artificial Sequence
  Description of Artificial Sequence: Synthetic peptide
  Seed: KHFLRNQPLTFALQ (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXLQ

SEQ ID NO: 329792 - protein, 15 aa, Artificial Sequence
  Description of Artificial Sequence: Synthetic peptide
  Seed: KHFLRNQPLTFALQL (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQL

SEQ ID NO: 329793 - protein, 15 aa, Artificial Sequence
  Description of Artificial Sequence: Synthetic peptide
  Seed: KHFLRNQPLTFALQL (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXLQL

SEQ ID NO: 329794 - protein, 15 aa, Artificial Sequence
  Description of Artificial Sequence: Synthetic peptide
  Seed: KHFLRNQPLTFALQL (PMEL_HUMAN)
  Core: RNQPLTFAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KHFLXNQXLXFAXQL

SEQ ID NO: 329795 - protein, 16 aa, Artificial Sequence
  Description of Artificial Sequence: Synthetic peptide
  Seed: KHFLRNQPLTFALQLH (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLH

SEQ ID NO: 329796 - protein, 16 aa, Artificial Sequence
  Description of Artificial Sequence: Synthetic peptide
  Seed: KHFLRNQPLTFALQLH (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXLQLH

SEQ ID NO: 329797 - protein, 16 aa, Artificial Sequence
  Description of Artificial Sequence: Synthetic peptide
  Seed: KHFLRNQPLTFALQLH (PMEL_HUMAN)
  Core: RNQPLTFAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KHFLXNQXLXFAXQLH

SEQ ID NO: 329798 - protein, 17 aa, Artificial Sequence
  Description of Artificial Sequence: Synthetic peptide
  Seed: KHFLRNQPLTFALQLHD (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHD

SEQ ID NO: 329799 - protein, 17 aa, Artificial Sequence
  Description of Artificial Sequence: Synthetic peptide
  Seed: KHFLRNQPLTFALQLHD (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXLQLHD

SEQ ID NO: 329800 - protein, 17 aa, Artificial Sequence
  Description of Artificial Sequence: Synthetic peptide
  Seed: KHFLRNQPLTFALQLHD (PMEL_HUMAN)
  Core: RNQPLTFAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KHFLXNQXLXFAXQLHD

SEQ ID NO: 329801 - protein, 17 aa, Artificial Sequence
  Description of Artificial Sequence: Synthetic peptide
  Seed: KHFLRNQPLTFALQLHD (PMEL_HUMAN)
  Core: NQPLTFALQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRXQPXTXALXLHD

SEQ ID NO: 329802 - protein, 17 aa, Artificial Sequence
  Description of Artificial Sequence: Synthetic peptide
  Seed: KHFLRNQPLTFALQLHD (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXD

SEQ ID NO: 329803 - protein, 17 aa, Artificial Sequence
  Description of Artificial Sequence: Synthetic peptide
  Seed: KHFLRNQPLTFALQLHD (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHX

SEQ ID NO: 329804 - protein, 18 aa, Artificial Sequence
  Description of Artificial Sequence: Synthetic peptide
  Seed: KHFLRNQPLTFALQLHDP (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDP

SEQ ID NO: 329805 - protein, 18 aa, Artificial Sequence
  Description of Artificial Sequence: Synthetic peptide
  Seed: KHFLRNQPLTFALQLHDP (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXLQLHDP

SEQ ID NO: 329806 - protein, 18 aa, Artificial Sequence
  Description of Artificial Sequence: Synthetic peptide
  Seed: KHFLRNQPLTFALQLHDP (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDP

SEQ ID NO: 329807 - protein, 18 aa, Artificial Sequence
  Description of Artificial Sequence: Synthetic peptide
  Seed: KHFLRNQPLTFALQLHDP (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXP

SEQ ID NO: 329808 - protein, 19 aa, Artificial Sequence
  Description of Artificial Sequence: Synthetic peptide
  Seed: KHFLRNQPLTFALQLHDPS (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPS

SEQ ID NO: 329809 - protein, 19 aa, Artificial Sequence
  Description of Artificial Sequence: Synthetic peptide
  Seed: KHFLRNQPLTFALQLHDPS (PMEL_HUMAN)
  Core: LRNQPLTFA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KHFXRNXPXTFXLQLHDPS

SEQ ID NO: 329810 - protein, 19 aa, Artificial Sequence
  Description of Artificial Sequence: Synthetic peptide
  Seed: KHFLRNQPLTFALQLHDPS (PMEL_HUMAN)
  Core: RNQPLTFAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KHFLXNQXLXFAXQLHDPS

SEQ ID NO: 329811 - protein, 19 aa, Artificial Sequence
  Description of Artificial Sequence: Synthetic peptide
  Seed: KHFLRNQPLTFALQLHDPS (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPS

SEQ ID NO: 329812 - protein, 19 aa, Artificial Sequence
  Description of Artificial Sequence: Synthetic peptide
  Seed: KHFLRNQPLTFALQLHDPS (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPS

SEQ ID NO: 329813 - protein, 20 aa, Artificial Sequence
  Description of Artificial Sequence: Synthetic peptide
  Seed: KHFLRNQPLTFALQLHDPSG (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPSG

SEQ ID NO: 329814 - protein, 20 aa, Artificial Sequence
  Description of Artificial Sequence: Synthetic peptide
  Seed: KHFLRNQPLTFALQLHDPSG (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPSG

SEQ ID NO: 329815 - protein, 20 aa, Artificial Sequence
  Description of Artificial Sequence: Synthetic peptide
  Seed: KHFLRNQPLTFALQLHDPSG (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPSG

SEQ ID NO: 329816 - protein, 20 aa, Artificial Sequence
  Description of Artificial Sequence: Synthetic peptide
  Seed: KHFLRNQPLTFALQLHDPSG (PMEL_HUMAN)
  Core: FALQLHDPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTXALXLXDPXG

SEQ ID NO: 329817 - protein, 21 aa, Artificial Sequence
  Description of Artificial Sequence: Synthetic peptide
  Seed: KHFLRNQPLTFALQLHDPSGY (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPSGY

SEQ ID NO: 329818 - protein, 21 aa, Artificial Sequence
  Description of Artificial Sequence: Synthetic peptide
  Seed: KHFLRNQPLTFALQLHDPSGY (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPSGY

SEQ ID NO: 329819 - protein, 21 aa, Artificial Sequence
  Description of Artificial Sequence: Synthetic peptide
  Seed: KHFLRNQPLTFALQLHDPSGY (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPSGY

SEQ ID NO: 329820 - protein, 21 aa, Artificial Sequence
  Description of Artificial Sequence: Synthetic peptide
  Seed: KHFLRNQPLTFALQLHDPSGY (PMEL_HUMAN)
  Core: FALQLHDPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTXALXLXDPXGY

SEQ ID NO: 329821 - protein, 22 aa, Artificial Sequence
  Description of Artificial Sequence: Synthetic peptide
  Seed: KHFLRNQPLTFALQLHDPSGYL (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPSGYL

SEQ ID NO: 329822 - protein, 22 aa, Artificial Sequence
  Description of Artificial Sequence: Synthetic peptide
  Seed: KHFLRNQPLTFALQLHDPSGYL (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPSGYL

SEQ ID NO: 329823 - protein, 22 aa, Artificial Sequence
  Description of Artificial Sequence: Synthetic peptide
  Seed: KHFLRNQPLTFALQLHDPSGYL (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPSGYL

SEQ ID NO: 329824 - protein, 22 aa, Artificial Sequence
  Description of Artificial Sequence: Synthetic peptide
  Seed: KHFLRNQPLTFALQLHDPSGYL (PMEL_HUMAN)
  Core: FALQLHDPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTXALXLXDPXGYL

SEQ ID NO: 329825 - protein, 23 aa, Artificial Sequence
  Description of Artificial Sequence: Synthetic peptide
  Seed: KHFLRNQPLTFALQLHDPSGYLA (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPSGYLA

SEQ ID NO: 329826 - protein, 23 aa, Artificial Sequence
  Description of Artificial Sequence: Synthetic peptide
  Seed: KHFLRNQPLTFALQLHDPSGYLA (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPSGYLA

SEQ ID NO: 329827 - protein, 23 aa, Artificial Sequence
  Description of Artificial Sequence: Synthetic peptide
  Seed: KHFLRNQPLTFALQLHDPSGYLA (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPSGYLA

SEQ ID NO: 329828 - protein, 23 aa, Artificial Sequence
  Description of Artificial Sequence: Synthetic peptide
  Seed: KHFLRNQPLTFALQLHDPSGYLA (PMEL_HUMAN)
  Core: FALQLHDPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTXALXLXDPXGYLA

SEQ ID NO: 329829 - protein, 24 aa, Artificial Sequence
  Description of Artificial Sequence: Synthetic peptide
  Seed: KHFLRNQPLTFALQLHDPSGYLAE (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPSGYLAE

SEQ ID NO: 329830 - protein, 24 aa, Artificial Sequence
  Description of Artificial Sequence: Synthetic peptide
  Seed: KHFLRNQPLTFALQLHDPSGYLAE (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPSGYLAE

SEQ ID NO: 329831 - protein, 24 aa, Artificial Sequence
  Description of Artificial Sequence: Synthetic peptide
  Seed: KHFLRNQPLTFALQLHDPSGYLAE (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPSGYLAE

SEQ ID NO: 329832 - protein, 24 aa, Artificial Sequence
  Description of Artificial Sequence: Synthetic peptide
  Seed: KHFLRNQPLTFALQLHDPSGYLAE (PMEL_HUMAN)
  Core: FALQLHDPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTXALXLXDPXGYLAE

SEQ ID NO: 329833 - protein, 24 aa, Artificial Sequence
  Description of Artificial Sequence: Synthetic peptide
  Seed: KHFLRNQPLTFALQLHDPSGYLAE (PMEL_HUMAN)
  Core: LQLHDPSGY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTFAXQLXDXSGXLAE

SEQ ID NO: 329834 - protein, 25 aa, Artificial Sequence
  Description of Artificial Sequence: Synthetic peptide
  Seed: KHFLRNQPLTFALQLHDPSGYLAEA (PMEL_HUMAN)
  Core: FLRNQPLTF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KHXLRXQXLTXALQLHDPSGYLAEA

SEQ ID NO: 329835 - protein, 25 aa, Artificial Sequence
  Description of Artificial Sequence: Synthetic peptide
  Seed: KHFLRNQPLTFALQLHDPSGYLAEA (PMEL_HUMAN)
  Core: PLTFALQLH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQXLTXAXQLXDPSGYLAEA

SEQ ID NO: 329836 - protein, 25 aa, Artificial Sequence
  Description of Artificial Sequence: Synthetic peptide
  Seed: KHFLRNQPLTFALQLHDPSGYLAEA (PMEL_HUMAN)
  Core: LTFALQLHD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPXTFXLXLHXPSGYLAEA

SEQ ID NO: 329837 - protein, 25 aa, Artificial Sequence
  Description of Artificial Sequence: Synthetic peptide
  Seed: KHFLRNQPLTFALQLHDPSGYLAEA (PMEL_HUMAN)
  Core: FALQLHDPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTXALXLXDPXGYLAEA

SEQ ID NO: 329838 - protein, 25 aa, Artificial Sequence
  Description of Artificial Sequence: Synthetic peptide
  Seed: KHFLRNQPLTFALQLHDPSGYLAEA (PMEL_HUMAN)
  Core: LQLHDPSGY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KHFLRNQPLTFAXQLXDXSGXLAEA

SEQ ID NO: 329839 - protein, 19 aa, Artificial Sequence
  Description of Artificial Sequence: Synthetic peptide
  Seed: KQDFSVPQLPHSSSHWLRL (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRL

SEQ ID NO: 329840 - protein, 20 aa, Artificial Sequence
  Description of Artificial Sequence: Synthetic peptide
  Seed: KQDFSVPQLPHSSSHWLRLP (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRLP

SEQ ID NO: 329841 - protein, 20 aa, Artificial Sequence
  Description of Artificial Sequence: Synthetic peptide
  Seed: KQDFSVPQLPHSSSHWLRLP (PMEL_HUMAN)
  Core: LPHSSSHWL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQXPHXSXHWXRLP

SEQ ID NO: 329842 - protein, 20 aa, Artificial Sequence
  Description of Artificial Sequence: Synthetic peptide
  Seed: KQDFSVPQLPHSSSHWLRLP (PMEL_HUMAN)
  Core: HSSSHWLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPXSSXHXLRXP

SEQ ID NO: 329843 - protein, 21 aa, Artificial Sequence
  Description of Artificial Sequence: Synthetic peptide
  Seed: KQDFSVPQLPHSSSHWLRLPR (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRLPR

SEQ ID NO: 329844 - protein, 21 aa, Artificial Sequence
  Description of Artificial Sequence: Synthetic peptide
  Seed: KQDFSVPQLPHSSSHWLRLPR (PMEL_HUMAN)
  Core: HSSSHWLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPXSSXHXLRXPR

SEQ ID NO: 329845 - protein, 22 aa, Artificial Sequence
  Description of Artificial Sequence: Synthetic peptide
  Seed: KQDFSVPQLPHSSSHWLRLPRI (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRLPRI

SEQ ID NO: 329846 - protein, 22 aa, Artificial Sequence
  Description of Artificial Sequence: Synthetic peptide
  Seed: KQDFSVPQLPHSSSHWLRLPRI (PMEL_HUMAN)
  Core: LPHSSSHWL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQXPHXSXHWXRLPRI

SEQ ID NO: 329847 - protein, 22 aa, Artificial Sequence
  Description of Artificial Sequence: Synthetic peptide
  Seed: KQDFSVPQLPHSSSHWLRLPRI (PMEL_HUMAN)
  Core: PHSSSHWLR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLXHSXSXWLXLPRI

SEQ ID NO: 329848 - protein, 22 aa, Artificial Sequence
  Description of Artificial Sequence: Synthetic peptide
  Seed: KQDFSVPQLPHSSSHWLRLPRI (PMEL_HUMAN)
  Core: HSSSHWLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPXSSXHXLRXPRI

SEQ ID NO: 329849 - protein, 23 aa, Artificial Sequence
  Description of Artificial Sequence: Synthetic peptide
  Seed: KQDFSVPQLPHSSSHWLRLPRIF (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRLPRIF

SEQ ID NO: 329850 - protein, 23 aa, Artificial Sequence
  Description of Artificial Sequence: Synthetic peptide
  Seed: KQDFSVPQLPHSSSHWLRLPRIF (PMEL_HUMAN)
  Core: LPHSSSHWL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQXPHXSXHWXRLPRIF

SEQ ID NO: 329851 - protein, 23 aa, Artificial Sequence
  Description of Artificial Sequence: Synthetic peptide
  Seed: KQDFSVPQLPHSSSHWLRLPRIF (PMEL_HUMAN)
  Core: PHSSSHWLR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLXHSXSXWLXLPRIF

SEQ ID NO: 329852 - protein, 23 aa, Artificial Sequence
  Description of Artificial Sequence: Synthetic peptide
  Seed: KQDFSVPQLPHSSSHWLRLPRIF (PMEL_HUMAN)
  Core: HSSSHWLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPXSSXHXLRXPRIF

SEQ ID NO: 329853 - protein, 24 aa, Artificial Sequence
  Description of Artificial Sequence: Synthetic peptide
  Seed: KQDFSVPQLPHSSSHWLRLPRIFC (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRLPRIFC

SEQ ID NO: 329854 - protein, 24 aa, Artificial Sequence
  Description of Artificial Sequence: Synthetic peptide
  Seed: KQDFSVPQLPHSSSHWLRLPRIFC (PMEL_HUMAN)
  Core: LPHSSSHWL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQXPHXSXHWXRLPRIFC

SEQ ID NO: 329855 - protein, 24 aa, Artificial Sequence
  Description of Artificial Sequence: Synthetic peptide
  Seed: KQDFSVPQLPHSSSHWLRLPRIFC (PMEL_HUMAN)
  Core: PHSSSHWLR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLXHSXSXWLXLPRIFC

SEQ ID NO: 329856 - protein, 24 aa, Artificial Sequence
  Description of Artificial Sequence: Synthetic peptide
  Seed: KQDFSVPQLPHSSSHWLRLPRIFC (PMEL_HUMAN)
  Core: HSSSHWLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPXSSXHXLRXPRIFC

SEQ ID NO: 329857 - protein, 25 aa, Artificial Sequence
  Description of Artificial Sequence: Synthetic peptide
  Seed: KQDFSVPQLPHSSSHWLRLPRIFCS (PMEL_HUMAN)
  Core: FSVPQLPHS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KQDXSVXQXPHXSSHWLRLPRIFCS

SEQ ID NO: 329858 - protein, 25 aa, Artificial Sequence
  Description of Artificial Sequence: Synthetic peptide
  Seed: KQDFSVPQLPHSSSHWLRLPRIFCS (PMEL_HUMAN)
  Core: SVPQLPHSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KQDFXVPXLXHSXSHWLRLPRIFCS

SEQ ID NO: 329859 - protein, 25 aa, Artificial Sequence
  Description of Artificial Sequence: Synthetic peptide
  Seed: KQDFSVPQLPHSSSHWLRLPRIFCS (PMEL_HUMAN)
  Core: LPHSSSHWL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQXPHXSXHWXRLPRIFCS

SEQ ID NO: 329860 - protein, 25 aa, Artificial Sequence
  Description of Artificial Sequence: Synthetic peptide
  Seed: KQDFSVPQLPHSSSHWLRLPRIFCS (PMEL_HUMAN)
  Core: PHSSSHWLR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLXHSXSXWLXLPRIFCS

SEQ ID NO: 329861 - protein, 25 aa, Artificial Sequence
  Description of Artificial Sequence: Synthetic peptide
  Seed: KQDFSVPQLPHSSSHWLRLPRIFCS (PMEL_HUMAN)
  Core: HSSSHWLRL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPXSSXHXLRXPRIFCS

SEQ ID NO: 329862 - protein, 25 aa, Artificial Sequence
  Description of Artificial Sequence: Synthetic peptide
  Seed: KQDFSVPQLPHSSSHWLRLPRIFCS (PMEL_HUMAN)
  Core: SHWLRLPRI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPHSSXHWXRXPRXFCS

SEQ ID NO: 329863 - protein, 25 aa, Artificial Sequence
  Description of Artificial Sequence: Synthetic peptide
  Seed: KQDFSVPQLPHSSSHWLRLPRIFCS (PMEL_HUMAN)
  Core: WLRLPRIFC
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
KQDFSVPQLPHSSSHXLRXPXIFXS

SEQ ID NO: 329864 - protein, 13 aa, Artificial Sequence
  Description of Artificial Sequence: Synthetic peptide
  Seed: KRCLLHLAVIGAL (PMEL_HUMAN)
  Core: RCLLHLAVI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXCLXHXAVXGAL

SEQ ID NO: 329865 - protein, 13 aa, Artificial Sequence
  Description of Artificial Sequence: Synthetic peptide
  Seed: KRCLLHLAVIGAL (PMEL_HUMAN)
  Core: LLHLAVIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRCXLHXAXIGXL

SEQ ID NO: 329866 - protein, 13 aa, Artificial Sequence
  Description of Artificial Sequence: Synthetic peptide
  Seed: KRCLLHLAVIGAL (PMEL_HUMAN)
  Core: LHLAVIGAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRCLXHLXVXGAX

SEQ ID NO: 329867 - protein, 14 aa, Artificial Sequence
  Description of Artificial Sequence: Synthetic peptide
  Seed: KRCLLHLAVIGALL (PMEL_HUMAN)
  Core: RCLLHLAVI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXCLXHXAVXGALL

SEQ ID NO: 329868 - protein, 14 aa, Artificial Sequence
  Description of Artificial Sequence: Synthetic peptide
  Seed: KRCLLHLAVIGALL (PMEL_HUMAN)
  Core: CLLHLAVIG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KRXLLXLXVIXALL

SEQ ID NO: 329869 - protein, 14 aa, Artificial Sequence
  Description of Artificial Sequence: Synthetic peptide
  Seed: KRCLLHLAVIGALL (PMEL_HUMAN)
  Core: LLHLAVIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRCXLHXAXIGXLL

SEQ ID NO: 329870 - protein, 14 aa, Artificial Sequence
  Description of Artificial Sequence: Synthetic peptide
  Seed: KRCLLHLAVIGALL (PMEL_HUMAN)
  Core: LHLAVIGAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRCLXHLXVXGAXL

SEQ ID NO: 329871 - protein, 15 aa, Artificial Sequence
  Description of Artificial Sequence: Synthetic peptide
  Seed: KRCLLHLAVIGALLA (PMEL_HUMAN)
  Core: CLLHLAVIG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KRXLLXLXVIXALLA

SEQ ID NO: 329872 - protein, 15 aa, Artificial Sequence
  Description of Artificial Sequence: Synthetic peptide
  Seed: KRCLLHLAVIGALLA (PMEL_HUMAN)
  Core: LLHLAVIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRCXLHXAXIGXLLA

SEQ ID NO: 329873 - protein, 15 aa, Artificial Sequence
  Description of Artificial Sequence: Synthetic peptide
  Seed: KRCLLHLAVIGALLA (PMEL_HUMAN)
  Core: LHLAVIGAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRCLXHLXVXGAXLA

SEQ ID NO: 329874 - protein, 15 aa, Artificial Sequence
  Description of Artificial Sequence: Synthetic peptide
  Seed: KRCLLHLAVIGALLA (PMEL_HUMAN)
  Core: HLAVIGALL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLXLAXIXALXA

SEQ ID NO: 329875 - protein, 15 aa, Artificial Sequence
  Description of Artificial Sequence: Synthetic peptide
  Seed: KRCLLHLAVIGALLA (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLX

SEQ ID NO: 329876 - protein, 16 aa, Artificial Sequence
  Description of Artificial Sequence: Synthetic peptide
  Seed: KRCLLHLAVIGALLAV (PMEL_HUMAN)
  Core: CLLHLAVIG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KRXLLXLXVIXALLAV

SEQ ID NO: 329877 - protein, 16 aa, Artificial Sequence
  Description of Artificial Sequence: Synthetic peptide
  Seed: KRCLLHLAVIGALLAV (PMEL_HUMAN)
  Core: LLHLAVIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRCXLHXAXIGXLLAV

SEQ ID NO: 329878 - protein, 16 aa, Artificial Sequence
  Description of Artificial Sequence: Synthetic peptide
  Seed: KRCLLHLAVIGALLAV (PMEL_HUMAN)
  Core: LHLAVIGAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRCLXHLXVXGAXLAV

SEQ ID NO: 329879 - protein, 16 aa, Artificial Sequence
  Description of Artificial Sequence: Synthetic peptide
  Seed: KRCLLHLAVIGALLAV (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXV

SEQ ID NO: 329880 - protein, 17 aa, Artificial Sequence
  Description of Artificial Sequence: Synthetic peptide
  Seed: KRCLLHLAVIGALLAVG (PMEL_HUMAN)
  Core: LLHLAVIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRCXLHXAXIGXLLAVG

SEQ ID NO: 329881 - protein, 17 aa, Artificial Sequence
  Description of Artificial Sequence: Synthetic peptide
  Seed: KRCLLHLAVIGALLAVG (PMEL_HUMAN)
  Core: LHLAVIGAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRCLXHLXVXGAXLAVG

SEQ ID NO: 329882 - protein, 17 aa, Artificial Sequence
  Description of Artificial Sequence: Synthetic peptide
  Seed: KRCLLHLAVIGALLAVG (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXVG

SEQ ID NO: 329883 - protein, 17 aa, Artificial Sequence
  Description of Artificial Sequence: Synthetic peptide
  Seed: KRCLLHLAVIGALLAVG (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVX

SEQ ID NO: 329884 - protein, 18 aa, Artificial Sequence
  Description of Artificial Sequence: Synthetic peptide
  Seed: KRCLLHLAVIGALLAVGA (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXVGA

SEQ ID NO: 329885 - protein, 18 aa, Artificial Sequence
  Description of Artificial Sequence: Synthetic peptide
  Seed: KRCLLHLAVIGALLAVGA (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXA

SEQ ID NO: 329886 - protein, 19 aa, Artificial Sequence
  Description of Artificial Sequence: Synthetic peptide
  Seed: KRCLLHLAVIGALLAVGAT (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXVGAT

SEQ ID NO: 329887 - protein, 19 aa, Artificial Sequence
  Description of Artificial Sequence: Synthetic peptide
  Seed: KRCLLHLAVIGALLAVGAT (PMEL_HUMAN)
  Core: AVIGALLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLXVIXAXLAXGAT

SEQ ID NO: 329888 - protein, 19 aa, Artificial Sequence
  Description of Artificial Sequence: Synthetic peptide
  Seed: KRCLLHLAVIGALLAVGAT (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXAT

SEQ ID NO: 329889 - protein, 19 aa, Artificial Sequence
  Description of Artificial Sequence: Synthetic peptide
  Seed: KRCLLHLAVIGALLAVGAT (PMEL_HUMAN)
  Core: IGALLAVGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVXGAXLXVGXT

SEQ ID NO: 329890 - protein, 20 aa, Artificial Sequence
  Description of Artificial Sequence: Synthetic peptide
  Seed: KRCLLHLAVIGALLAVGATK (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXVGATK

SEQ ID NO: 329891 - protein, 20 aa, Artificial Sequence
  Description of Artificial Sequence: Synthetic peptide
  Seed: KRCLLHLAVIGALLAVGATK (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXATK

SEQ ID NO: 329892 - protein, 20 aa, Artificial Sequence
  Description of Artificial Sequence: Synthetic peptide
  Seed: KRCLLHLAVIGALLAVGATK (PMEL_HUMAN)
  Core: IGALLAVGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVXGAXLXVGXTK

SEQ ID NO: 329893 - protein, 21 aa, Artificial Sequence
  Description of Artificial Sequence: Synthetic peptide
  Seed: KRCLLHLAVIGALLAVGATKV (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXVGATKV

SEQ ID NO: 329894 - protein, 21 aa, Artificial Sequence
  Description of Artificial Sequence: Synthetic peptide
  Seed: KRCLLHLAVIGALLAVGATKV (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXATKV

SEQ ID NO: 329895 - protein, 21 aa, Artificial Sequence
  Description of Artificial Sequence: Synthetic peptide
  Seed: KRCLLHLAVIGALLAVGATKV (PMEL_HUMAN)
  Core: IGALLAVGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVXGAXLXVGXTKV

SEQ ID NO: 329896 - protein, 21 aa, Artificial Sequence
  Description of Artificial Sequence: Synthetic peptide
  Seed: KRCLLHLAVIGALLAVGATKV (PMEL_HUMAN)
  Core: LLAVGATKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVIGAXLAXGXTKX

SEQ ID NO: 329897 - protein, 22 aa, Artificial Sequence
  Description of Artificial Sequence: Synthetic peptide
  Seed: KRCLLHLAVIGALLAVGATKVP (PMEL_HUMAN)
  Core: LAVIGALLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHXAVXGXLLXVGATKVP

SEQ ID NO: 329898 - protein, 22 aa, Artificial Sequence
  Description of Artificial Sequence: Synthetic peptide
  Seed: KRCLLHLAVIGALLAVGATKVP (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXATKVP

SEQ ID NO: 329899 - protein, 22 aa, Artificial Sequence
  Description of Artificial Sequence: Synthetic peptide
  Seed: KRCLLHLAVIGALLAVGATKVP (PMEL_HUMAN)
  Core: IGALLAVGA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVXGAXLXVGXTKVP

SEQ ID NO: 329900 - protein, 22 aa, Artificial Sequence
  Description of Artificial Sequence: Synthetic peptide
  Seed: KRCLLHLAVIGALLAVGATKVP (PMEL_HUMAN)
  Core: LLAVGATKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVIGAXLAXGXTKXP

SEQ ID NO: 329901 - protein, 23 aa, Artificial Sequence
  Description of Artificial Sequence: Synthetic peptide
  Seed: KRCLLHLAVIGALLAVGATKVPR (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXATKVPR

SEQ ID NO: 329902 - protein, 23 aa, Artificial Sequence
  Description of Artificial Sequence: Synthetic peptide
  Seed: KRCLLHLAVIGALLAVGATKVPR (PMEL_HUMAN)
  Core: LLAVGATKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVIGAXLAXGXTKXPR

SEQ ID NO: 329903 - protein, 24 aa, Artificial Sequence
  Description of Artificial Sequence: Synthetic peptide
  Seed: KRCLLHLAVIGALLAVGATKVPRN (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXATKVPRN

SEQ ID NO: 329904 - protein, 24 aa, Artificial Sequence
  Description of Artificial Sequence: Synthetic peptide
  Seed: KRCLLHLAVIGALLAVGATKVPRN (PMEL_HUMAN)
  Core: LLAVGATKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVIGAXLAXGXTKXPRN

SEQ ID NO: 329905 - protein, 25 aa, Artificial Sequence
  Description of Artificial Sequence: Synthetic peptide
  Seed: KRCLLHLAVIGALLAVGATKVPRNQ (PMEL_HUMAN)
  Core: VIGALLAVG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAXIGXLXAVXATKVPRNQ

SEQ ID NO: 329906 - protein, 25 aa, Artificial Sequence
  Description of Artificial Sequence: Synthetic peptide
  Seed: KRCLLHLAVIGALLAVGATKVPRNQ (PMEL_HUMAN)
  Core: LLAVGATKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRCLLHLAVIGAXLAXGXTKXPRNQ

SEQ ID NO: 329907 - protein, 14 aa, Artificial Sequence
  Description of Artificial Sequence: Synthetic peptide
  Seed: KRQVPLDCVLYRYG (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYG

SEQ ID NO: 329908 - protein, 15 aa, Artificial Sequence
  Description of Artificial Sequence: Synthetic peptide
  Seed: KRQVPLDCVLYRYGS (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYGS

SEQ ID NO: 329909 - protein, 16 aa, Artificial Sequence
  Description of Artificial Sequence: Synthetic peptide
  Seed: KRQVPLDCVLYRYGSF (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYGSF

SEQ ID NO: 329910 - protein, 16 aa, Artificial Sequence
  Description of Artificial Sequence: Synthetic peptide
  Seed: KRQVPLDCVLYRYGSF (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSF

SEQ ID NO: 329911 - protein, 17 aa, Artificial Sequence
  Description of Artificial Sequence: Synthetic peptide
  Seed: KRQVPLDCVLYRYGSFS (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYGSFS

SEQ ID NO: 329912 - protein, 17 aa, Artificial Sequence
  Description of Artificial Sequence: Synthetic peptide
  Seed: KRQVPLDCVLYRYGSFS (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFS

SEQ ID NO: 329913 - protein, 18 aa, Artificial Sequence
  Description of Artificial Sequence: Synthetic peptide
  Seed: KRQVPLDCVLYRYGSFSV (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFSV

SEQ ID NO: 329914 - protein, 18 aa, Artificial Sequence
  Description of Artificial Sequence: Synthetic peptide
  Seed: KRQVPLDCVLYRYGSFSV (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSX

SEQ ID NO: 329915 - protein, 19 aa, Artificial Sequence
  Description of Artificial Sequence: Synthetic peptide
  Seed: KRQVPLDCVLYRYGSFSVT (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYGSFSVT

SEQ ID NO: 329916 - protein, 19 aa, Artificial Sequence
  Description of Artificial Sequence: Synthetic peptide
  Seed: KRQVPLDCVLYRYGSFSVT (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFSVT

SEQ ID NO: 329917 - protein, 19 aa, Artificial Sequence
  Description of Artificial Sequence: Synthetic peptide
  Seed: KRQVPLDCVLYRYGSFSVT (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXT

SEQ ID NO: 329918 - protein, 19 aa, Artificial Sequence
  Description of Artificial Sequence: Synthetic peptide
  Seed: KRQVPLDCVLYRYGSFSVT (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVX

SEQ ID NO: 329919 - protein, 20 aa, Artificial Sequence
  Description of Artificial Sequence: Synthetic peptide
  Seed: KRQVPLDCVLYRYGSFSVTL (PMEL_HUMAN)
  Core: QVPLDCVLY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
KRXVPXDXVLXRYGSFSVTL

SEQ ID NO: 329920 - protein, 20 aa, Artificial Sequence
  Description of Artificial Sequence: Synthetic peptide
  Seed: KRQVPLDCVLYRYGSFSVTL (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYGSFSVTL

SEQ ID NO: 329921 - protein, 20 aa, Artificial Sequence
  Description of Artificial Sequence: Synthetic peptide
  Seed: KRQVPLDCVLYRYGSFSVTL (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFSVTL

SEQ ID NO: 329922 - protein, 20 aa, Artificial Sequence
  Description of Artificial Sequence: Synthetic peptide
  Seed: KRQVPLDCVLYRYGSFSVTL (PMEL_HUMAN)
  Core: CVLYRYGSF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDXVLXRXGSXSVTL

SEQ ID NO: 329923 - protein, 20 aa, Artificial Sequence
  Description of Artificial Sequence: Synthetic peptide
  Seed: KRQVPLDCVLYRYGSFSVTL (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXTL

SEQ ID NO: 329924 - protein, 20 aa, Artificial Sequence
  Description of Artificial Sequence: Synthetic peptide
  Seed: KRQVPLDCVLYRYGSFSVTL (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVXL

SEQ ID NO: 329925 - protein, 20 aa, Artificial Sequence
  Description of Artificial Sequence: Synthetic peptide
  Seed: KRQVPLDCVLYRYGSFSVTL (PMEL_HUMAN)
  Core: RYGSFSVTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYXYGXFXVTX

SEQ ID NO: 329926 - protein, 21 aa, Artificial Sequence
  Description of Artificial Sequence: Synthetic peptide
  Seed: KRQVPLDCVLYRYGSFSVTLD (PMEL_HUMAN)
  Core: VPLDCVLYR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRQXPLXCXLYXYGSFSVTLD

SEQ ID NO: 329927 - protein, 21 aa, Artificial Sequence
  Description of Artificial Sequence: Synthetic peptide
  Seed: KRQVPLDCVLYRYGSFSVTLD (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFSVTLD

SEQ ID NO: 329928 - protein, 21 aa, Artificial Sequence
  Description of Artificial Sequence: Synthetic peptide
  Seed: KRQVPLDCVLYRYGSFSVTLD (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXTLD

SEQ ID NO: 329929 - protein, 21 aa, Artificial Sequence
  Description of Artificial Sequence: Synthetic peptide
  Seed: KRQVPLDCVLYRYGSFSVTLD (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVXLD

SEQ ID NO: 329930 - protein, 21 aa, Artificial Sequence
  Description of Artificial Sequence: Synthetic peptide
  Seed: KRQVPLDCVLYRYGSFSVTLD (PMEL_HUMAN)
  Core: RYGSFSVTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYXYGXFXVTXD

SEQ ID NO: 329931 - protein, 22 aa, Artificial Sequence
  Description of Artificial Sequence: Synthetic peptide
  Seed: KRQVPLDCVLYRYGSFSVTLDI (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFSVTLDI

SEQ ID NO: 329932 - protein, 22 aa, Artificial Sequence
  Description of Artificial Sequence: Synthetic peptide
  Seed: KRQVPLDCVLYRYGSFSVTLDI (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXTLDI

SEQ ID NO: 329933 - protein, 22 aa, Artificial Sequence
  Description of Artificial Sequence: Synthetic peptide
  Seed: KRQVPLDCVLYRYGSFSVTLDI (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVXLDI

SEQ ID NO: 329934 - protein, 22 aa, Artificial Sequence
  Description of Artificial Sequence: Synthetic peptide
  Seed: KRQVPLDCVLYRYGSFSVTLDI (PMEL_HUMAN)
  Core: RYGSFSVTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYXYGXFXVTXDI

SEQ ID NO: 329935 - protein, 22 aa, Artificial Sequence
  Description of Artificial Sequence: Synthetic peptide
  Seed: KRQVPLDCVLYRYGSFSVTLDI (PMEL_HUMAN)
  Core: YGSFSVTLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYRXGSXSXTLXI

SEQ ID NO: 329936 - protein, 23 aa, Artificial Sequence
  Description of Artificial Sequence: Synthetic peptide
  Seed: KRQVPLDCVLYRYGSFSVTLDIV (PMEL_HUMAN)
  Core: LDCVLYRYG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPXDCXLXRYXSFSVTLDIV

SEQ ID NO: 329937 - protein, 23 aa, Artificial Sequence
  Description of Artificial Sequence: Synthetic peptide
  Seed: KRQVPLDCVLYRYGSFSVTLDIV (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXTLDIV

SEQ ID NO: 329938 - protein, 23 aa, Artificial Sequence
  Description of Artificial Sequence: Synthetic peptide
  Seed: KRQVPLDCVLYRYGSFSVTLDIV (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVXLDIV

SEQ ID NO: 329939 - protein, 23 aa, Artificial Sequence
  Description of Artificial Sequence: Synthetic peptide
  Seed: KRQVPLDCVLYRYGSFSVTLDIV (PMEL_HUMAN)
  Core: RYGSFSVTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYXYGXFXVTXDIV

SEQ ID NO: 329940 - protein, 23 aa, Artificial Sequence
  Description of Artificial Sequence: Synthetic peptide
  Seed: KRQVPLDCVLYRYGSFSVTLDIV (PMEL_HUMAN)
  Core: YGSFSVTLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYRXGSXSXTLXIV

SEQ ID NO: 329941 - protein, 24 aa, Artificial Sequence
  Description of Artificial Sequence: Synthetic peptide
  Seed: KRQVPLDCVLYRYGSFSVTLDIVQ (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXTLDIVQ

SEQ ID NO: 329942 - protein, 24 aa, Artificial Sequence
  Description of Artificial Sequence: Synthetic peptide
  Seed: KRQVPLDCVLYRYGSFSVTLDIVQ (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVXLDIVQ

SEQ ID NO: 329943 - protein, 24 aa, Artificial Sequence
  Description of Artificial Sequence: Synthetic peptide
  Seed: KRQVPLDCVLYRYGSFSVTLDIVQ (PMEL_HUMAN)
  Core: RYGSFSVTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYXYGXFXVTXDIVQ

SEQ ID NO: 329944 - protein, 24 aa, Artificial Sequence
  Description of Artificial Sequence: Synthetic peptide
  Seed: KRQVPLDCVLYRYGSFSVTLDIVQ (PMEL_HUMAN)
  Core: YGSFSVTLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYRXGSXSXTLXIVQ

SEQ ID NO: 329945 - protein, 24 aa, Artificial Sequence
  Description of Artificial Sequence: Synthetic peptide
  Seed: KRQVPLDCVLYRYGSFSVTLDIVQ (PMEL_HUMAN)
  Core: SFSVTLDIV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYRYGXFSXTXDIXQ

SEQ ID NO: 329946 - protein, 25 aa, Artificial Sequence
  Description of Artificial Sequence: Synthetic peptide
  Seed: KRQVPLDCVLYRYGSFSVTLDIVQG (PMEL_HUMAN)
  Core: LYRYGSFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVXYRXGXFSXTLDIVQG

SEQ ID NO: 329947 - protein, 25 aa, Artificial Sequence
  Description of Artificial Sequence: Synthetic peptide
  Seed: KRQVPLDCVLYRYGSFSVTLDIVQG (PMEL_HUMAN)
  Core: YRYGSFSVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLXRYXSXSVXLDIVQG

SEQ ID NO: 329948 - protein, 25 aa, Artificial Sequence
  Description of Artificial Sequence: Synthetic peptide
  Seed: KRQVPLDCVLYRYGSFSVTLDIVQG (PMEL_HUMAN)
  Core: RYGSFSVTL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYXYGXFXVTXDIVQG

SEQ ID NO: 329949 - protein, 25 aa, Artificial Sequence
  Description of Artificial Sequence: Synthetic peptide
  Seed: KRQVPLDCVLYRYGSFSVTLDIVQG (PMEL_HUMAN)
  Core: YGSFSVTLD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYRXGSXSXTLXIVQG

SEQ ID NO: 329950 - protein, 25 aa, Artificial Sequence
  Description of Artificial Sequence: Synthetic peptide
  Seed: KRQVPLDCVLYRYGSFSVTLDIVQG (PMEL_HUMAN)
  Core: SFSVTLDIV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KRQVPLDCVLYRYGXFSXTXDIXQG

SEQ ID NO: 329951 - protein, 13 aa, Artificial Sequence
  Description of Artificial Sequence: Synthetic peptide
  Seed: KRSFVYVWKTWGQ (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQ

SEQ ID NO: 329952 - protein, 14 aa, Artificial Sequence
  Description of Artificial Sequence: Synthetic peptide
  Seed: KRSFVYVWKTWGQY (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQY

SEQ ID NO: 329953 - protein, 14 aa, Artificial Sequence
  Description of Artificial Sequence: Synthetic peptide
  Seed: KRSFVYVWKTWGQY (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXY

SEQ ID NO: 329954 - protein, 14 aa, Artificial Sequence
  Description of Artificial Sequence: Synthetic peptide
  Seed: KRSFVYVWKTWGQY (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQX

SEQ ID NO: 329955 - protein, 15 aa, Artificial Sequence
  Description of Artificial Sequence: Synthetic peptide
  Seed: KRSFVYVWKTWGQYW (PMEL_HUMAN)
  Core: RSFVYVWKT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
KXSFXYXWKXWGQYW

SEQ ID NO: 329956 - protein, 15 aa, Artificial Sequence
  Description of Artificial Sequence: Synthetic peptide
  Seed: KRSFVYVWKTWGQYW (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYW

SEQ ID NO: 329957 - protein, 15 aa, Artificial Sequence
  Description of Artificial Sequence: Synthetic peptide
  Seed: KRSFVYVWKTWGQYW (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYW

SEQ ID NO: 329958 - protein, 15 aa, Artificial Sequence
  Description of Artificial Sequence: Synthetic peptide
  Seed: KRSFVYVWKTWGQYW (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXW

SEQ ID NO: 329959 - protein, 16 aa, Artificial Sequence
  Description of Artificial Sequence: Synthetic peptide
  Seed: KRSFVYVWKTWGQYWQ (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQ

SEQ ID NO: 329960 - protein, 16 aa, Artificial Sequence
  Description of Artificial Sequence: Synthetic peptide
  Seed: KRSFVYVWKTWGQYWQ (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQ

SEQ ID NO: 329961 - protein, 16 aa, Artificial Sequence
  Description of Artificial Sequence: Synthetic peptide
  Seed: KRSFVYVWKTWGQYWQ (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQ

SEQ ID NO: 329962 - protein, 17 aa, Artificial Sequence
  Description of Artificial Sequence: Synthetic peptide
  Seed: KRSFVYVWKTWGQYWQV (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQV

SEQ ID NO: 329963 - protein, 17 aa, Artificial Sequence
  Description of Artificial Sequence: Synthetic peptide
  Seed: KRSFVYVWKTWGQYWQV (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQV

SEQ ID NO: 329964 - protein, 17 aa, Artificial Sequence
  Description of Artificial Sequence: Synthetic peptide
  Seed: KRSFVYVWKTWGQYWQV (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQV

SEQ ID NO: 329965 - protein, 18 aa, Artificial Sequence
  Description of Artificial Sequence: Synthetic peptide
  Seed: KRSFVYVWKTWGQYWQVL (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVL

SEQ ID NO: 329966 - protein, 18 aa, Artificial Sequence
  Description of Artificial Sequence: Synthetic peptide
  Seed: KRSFVYVWKTWGQYWQVL (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVL

SEQ ID NO: 329967 - protein, 18 aa, Artificial Sequence
  Description of Artificial Sequence: Synthetic peptide
  Seed: KRSFVYVWKTWGQYWQVL (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVL

SEQ ID NO: 329968 - protein, 19 aa, Artificial Sequence
  Description of Artificial Sequence: Synthetic peptide
  Seed: KRSFVYVWKTWGQYWQVLG (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLG

SEQ ID NO: 329969 - protein, 19 aa, Artificial Sequence
  Description of Artificial Sequence: Synthetic peptide
  Seed: KRSFVYVWKTWGQYWQVLG (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLG

SEQ ID NO: 329970 - protein, 19 aa, Artificial Sequence
  Description of Artificial Sequence: Synthetic peptide
  Seed: KRSFVYVWKTWGQYWQVLG (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLG

SEQ ID NO: 329971 - protein, 20 aa, Artificial Sequence
  Description of Artificial Sequence: Synthetic peptide
  Seed: KRSFVYVWKTWGQYWQVLGG (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLGG

SEQ ID NO: 329972 - protein, 20 aa, Artificial Sequence
  Description of Artificial Sequence: Synthetic peptide
  Seed: KRSFVYVWKTWGQYWQVLGG (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLGG

SEQ ID NO: 329973 - protein, 20 aa, Artificial Sequence
  Description of Artificial Sequence: Synthetic peptide
  Seed: KRSFVYVWKTWGQYWQVLGG (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLGG

SEQ ID NO: 329974 - protein, 21 aa, Artificial Sequence
  Description of Artificial Sequence: Synthetic peptide
  Seed: KRSFVYVWKTWGQYWQVLGGP (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLGGP

SEQ ID NO: 329975 - protein, 21 aa, Artificial Sequence
  Description of Artificial Sequence: Synthetic peptide
  Seed: KRSFVYVWKTWGQYWQVLGGP (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLGGP

SEQ ID NO: 329976 - protein, 21 aa, Artificial Sequence
  Description of Artificial Sequence: Synthetic peptide
  Seed: KRSFVYVWKTWGQYWQVLGGP (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLGGP

SEQ ID NO: 329977 - protein, 21 aa, Artificial Sequence
  Description of Artificial Sequence: Synthetic peptide
  Seed: KRSFVYVWKTWGQYWQVLGGP (PMEL_HUMAN)
  Core: TWGQYWQVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKXWGXYXQVXGGP

SEQ ID NO: 329978 - protein, 22 aa, Artificial Sequence
  Description of Artificial Sequence: Synthetic peptide
  Seed: KRSFVYVWKTWGQYWQVLGGPV (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLGGPV

SEQ ID NO: 329979 - protein, 22 aa, Artificial Sequence
  Description of Artificial Sequence: Synthetic peptide
  Seed: KRSFVYVWKTWGQYWQVLGGPV (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLGGPV

SEQ ID NO: 329980 - protein, 22 aa, Artificial Sequence
  Description of Artificial Sequence: Synthetic peptide
  Seed: KRSFVYVWKTWGQYWQVLGGPV (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLGGPV

SEQ ID NO: 329981 - protein, 22 aa, Artificial Sequence
  Description of Artificial Sequence: Synthetic peptide
  Seed: KRSFVYVWKTWGQYWQVLGGPV (PMEL_HUMAN)
  Core: TWGQYWQVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKXWGXYXQVXGGPV

SEQ ID NO: 329982 - protein, 22 aa, Artificial Sequence
  Description of Artificial Sequence: Synthetic peptide
  Seed: KRSFVYVWKTWGQYWQVLGGPV (PMEL_HUMAN)
  Core: YWQVLGGPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWGQXWQXLXGPX

SEQ ID NO: 329983 - protein, 23 aa, Artificial Sequence
  Description of Artificial Sequence: Synthetic peptide
  Seed: KRSFVYVWKTWGQYWQVLGGPVS (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLGGPVS

SEQ ID NO: 329984 - protein, 23 aa, Artificial Sequence
  Description of Artificial Sequence: Synthetic peptide
  Seed: KRSFVYVWKTWGQYWQVLGGPVS (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLGGPVS

SEQ ID NO: 329985 - protein, 23 aa, Artificial Sequence
  Description of Artificial Sequence: Synthetic peptide
  Seed: KRSFVYVWKTWGQYWQVLGGPVS (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLGGPVS

SEQ ID NO: 329986 - protein, 23 aa, Artificial Sequence
  Description of Artificial Sequence: Synthetic peptide
  Seed: KRSFVYVWKTWGQYWQVLGGPVS (PMEL_HUMAN)
  Core: TWGQYWQVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKXWGXYXQVXGGPVS

SEQ ID NO: 329987 - protein, 23 aa, Artificial Sequence
  Description of Artificial Sequence: Synthetic peptide
  Seed: KRSFVYVWKTWGQYWQVLGGPVS (PMEL_HUMAN)
  Core: GQYWQVLGG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWXQYXQXLGXPVS

SEQ ID NO: 329988 - protein, 23 aa, Artificial Sequence
  Description of Artificial Sequence: Synthetic peptide
  Seed: KRSFVYVWKTWGQYWQVLGGPVS (PMEL_HUMAN)
  Core: YWQVLGGPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWGQXWQXLXGPXS

SEQ ID NO: 329989 - protein, 24 aa, Artificial Sequence
  Description of Artificial Sequence: Synthetic peptide
  Seed: KRSFVYVWKTWGQYWQVLGGPVSG (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLGGPVSG

SEQ ID NO: 329990 - protein, 24 aa, Artificial Sequence
  Description of Artificial Sequence: Synthetic peptide
  Seed: KRSFVYVWKTWGQYWQVLGGPVSG (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLGGPVSG

SEQ ID NO: 329991 - protein, 24 aa, Artificial Sequence
  Description of Artificial Sequence: Synthetic peptide
  Seed: KRSFVYVWKTWGQYWQVLGGPVSG (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLGGPVSG

SEQ ID NO: 329992 - protein, 24 aa, Artificial Sequence
  Description of Artificial Sequence: Synthetic peptide
  Seed: KRSFVYVWKTWGQYWQVLGGPVSG (PMEL_HUMAN)
  Core: TWGQYWQVL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKXWGXYXQVXGGPVSG

SEQ ID NO: 329993 - protein, 24 aa, Artificial Sequence
  Description of Artificial Sequence: Synthetic peptide
  Seed: KRSFVYVWKTWGQYWQVLGGPVSG (PMEL_HUMAN)
  Core: GQYWQVLGG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWXQYXQXLGXPVSG

SEQ ID NO: 329994 - protein, 24 aa, Artificial Sequence
  Description of Artificial Sequence: Synthetic peptide
  Seed: KRSFVYVWKTWGQYWQVLGGPVSG (PMEL_HUMAN)
  Core: YWQVLGGPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWGQXWQXLXGPXSG

SEQ ID NO: 329995 - protein, 24 aa, Artificial Sequence
  Description of Artificial Sequence: Synthetic peptide
  Seed: KRSFVYVWKTWGQYWQVLGGPVSG (PMEL_HUMAN)
  Core: WQVLGGPVS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWGQYXQVXGXPVXG

SEQ ID NO: 329996 - protein, 25 aa, Artificial Sequence
  Description of Artificial Sequence: Synthetic peptide
  Seed: KRSFVYVWKTWGQYWQVLGGPVSGL (PMEL_HUMAN)
  Core: FVYVWKTWG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KRSXVYXWXTWXQYWQVLGGPVSGL

SEQ ID NO: 329997 - protein, 25 aa, Artificial Sequence
  Description of Artificial Sequence: Synthetic peptide
  Seed: KRSFVYVWKTWGQYWQVLGGPVSGL (PMEL_HUMAN)
  Core: VYVWKTWGQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
KRSFXYVXKXWGXYWQVLGGPVSGL

SEQ ID NO: 329998 - protein, 25 aa, Artificial Sequence
  Description of Artificial Sequence: Synthetic peptide
  Seed: KRSFVYVWKTWGQYWQVLGGPVSGL (PMEL_HUMAN)
  Core: YVWKTWGQY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVXVWXTXGQXWQVLGGPVSGL

SEQ ID NO: 329999 - protein, 25 aa, Artificial Sequence
  Description of Artificial Sequence: Synthetic peptide
  Seed: KRSFVYVWKTWGQYWQVLGGPVSGL (PMEL_HUMAN)
  Core: GQYWQVLGG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWXQYXQXLGXPVSGL

SEQ ID NO: 330000 - protein, 25 aa, Artificial Sequence
  Description of Artificial Sequence: Synthetic peptide
  Seed: KRSFVYVWKTWGQYWQVLGGPVSGL (PMEL_HUMAN)
  Core: YWQVLGGPV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWGQXWQXLXGPXSGL

SEQ ID NO: 330001 - protein, 25 aa, Artificial Sequence
  Description of Artificial Sequence: Synthetic peptide
  Seed: KRSFVYVWKTWGQYWQVLGGPVSGL (PMEL_HUMAN)
  Core: WQVLGGPVS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KRSFVYVWKTWGQYXQVXGXPVXGL

SEQ ID NO: 330002 - protein, 14 aa, Artificial Sequence
  Description of Artificial Sequence: Synthetic peptide
  Seed: KTWGQYWQVLGGPV (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPX

SEQ ID NO: 330003 - protein, 15 aa, Artificial Sequence
  Description of Artificial Sequence: Synthetic peptide
  Seed: KTWGQYWQVLGGPVS (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVS

SEQ ID NO: 330004 - protein, 15 aa, Artificial Sequence
  Description of Artificial Sequence: Synthetic peptide
  Seed: KTWGQYWQVLGGPVS (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXS

SEQ ID NO: 330005 - protein, 15 aa, Artificial Sequence
  Description of Artificial Sequence: Synthetic peptide
  Seed: KTWGQYWQVLGGPVS (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVX

SEQ ID NO: 330006 - protein, 16 aa, Artificial Sequence
  Description of Artificial Sequence: Synthetic peptide
  Seed: KTWGQYWQVLGGPVSG (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVSG

SEQ ID NO: 330007 - protein, 16 aa, Artificial Sequence
  Description of Artificial Sequence: Synthetic peptide
  Seed: KTWGQYWQVLGGPVSG (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSG

SEQ ID NO: 330008 - protein, 16 aa, Artificial Sequence
  Description of Artificial Sequence: Synthetic peptide
  Seed: KTWGQYWQVLGGPVSG (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXG

SEQ ID NO: 330009 - protein, 17 aa, Artificial Sequence
  Description of Artificial Sequence: Synthetic peptide
  Seed: KTWGQYWQVLGGPVSGL (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVSGL

SEQ ID NO: 330010 - protein, 17 aa, Artificial Sequence
  Description of Artificial Sequence: Synthetic peptide
  Seed: KTWGQYWQVLGGPVSGL (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGL

SEQ ID NO: 330011 - protein, 17 aa, Artificial Sequence
  Description of Artificial Sequence: Synthetic peptide
  Seed: KTWGQYWQVLGGPVSGL (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGL

SEQ ID NO: 330012 - protein, 18 aa, Artificial Sequence
  Description of Artificial Sequence: Synthetic peptide
  Seed: KTWGQYWQVLGGPVSGLS (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLS

SEQ ID NO: 330013 - protein, 18 aa, Artificial Sequence
  Description of Artificial Sequence: Synthetic peptide
  Seed: KTWGQYWQVLGGPVSGLS (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLS

SEQ ID NO: 330014 - protein, 18 aa, Artificial Sequence
  Description of Artificial Sequence: Synthetic peptide
  Seed: KTWGQYWQVLGGPVSGLS (PMEL_HUMAN)
  Core: VLGGPVSGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQXLGXPXSGXS

SEQ ID NO: 330015 - protein, 19 aa, Artificial Sequence
  Description of Artificial Sequence: Synthetic peptide
  Seed: KTWGQYWQVLGGPVSGLSI (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVSGLSI

SEQ ID NO: 330016 - protein, 19 aa, Artificial Sequence
  Description of Artificial Sequence: Synthetic peptide
  Seed: KTWGQYWQVLGGPVSGLSI (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSI

SEQ ID NO: 330017 - protein, 19 aa, Artificial Sequence
  Description of Artificial Sequence: Synthetic peptide
  Seed: KTWGQYWQVLGGPVSGLSI (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSI

SEQ ID NO: 330018 - protein, 19 aa, Artificial Sequence
  Description of Artificial Sequence: Synthetic peptide
  Seed: KTWGQYWQVLGGPVSGLSI (PMEL_HUMAN)
  Core: VLGGPVSGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQXLGXPXSGXSI

SEQ ID NO: 330019 - protein, 20 aa, Artificial Sequence
  Description of Artificial Sequence: Synthetic peptide
  Seed: KTWGQYWQVLGGPVSGLSIG (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVSGLSIG

SEQ ID NO: 330020 - protein, 20 aa, Artificial Sequence
  Description of Artificial Sequence: Synthetic peptide
  Seed: KTWGQYWQVLGGPVSGLSIG (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSIG

SEQ ID NO: 330021 - protein, 20 aa, Artificial Sequence
  Description of Artificial Sequence: Synthetic peptide
  Seed: KTWGQYWQVLGGPVSGLSIG (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSIG

SEQ ID NO: 330022 - protein, 20 aa, Artificial Sequence
  Description of Artificial Sequence: Synthetic peptide
  Seed: KTWGQYWQVLGGPVSGLSIG (PMEL_HUMAN)
  Core: VLGGPVSGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQXLGXPXSGXSIG

SEQ ID NO: 330023 - protein, 21 aa, Artificial Sequence
  Description of Artificial Sequence: Synthetic peptide
  Seed: KTWGQYWQVLGGPVSGLSIGT (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSIGT

SEQ ID NO: 330024 - protein, 21 aa, Artificial Sequence
  Description of Artificial Sequence: Synthetic peptide
  Seed: KTWGQYWQVLGGPVSGLSIGT (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSIGT

SEQ ID NO: 330025 - protein, 21 aa, Artificial Sequence
  Description of Artificial Sequence: Synthetic peptide
  Seed: KTWGQYWQVLGGPVSGLSIGT (PMEL_HUMAN)
  Core: VLGGPVSGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQXLGXPXSGXSIGT

SEQ ID NO: 330026 - protein, 22 aa, Artificial Sequence
  Description of Artificial Sequence: Synthetic peptide
  Seed: KTWGQYWQVLGGPVSGLSIGTG (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVSGLSIGTG

SEQ ID NO: 330027 - protein, 22 aa, Artificial Sequence
  Description of Artificial Sequence: Synthetic peptide
  Seed: KTWGQYWQVLGGPVSGLSIGTG (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSIGTG

SEQ ID NO: 330028 - protein, 22 aa, Artificial Sequence
  Description of Artificial Sequence: Synthetic peptide
  Seed: KTWGQYWQVLGGPVSGLSIGTG (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSIGTG

SEQ ID NO: 330029 - protein, 22 aa, Artificial Sequence
  Description of Artificial Sequence: Synthetic peptide
  Seed: KTWGQYWQVLGGPVSGLSIGTG (PMEL_HUMAN)
  Core: VLGGPVSGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQXLGXPXSGXSIGTG

SEQ ID NO: 330030 - protein, 22 aa, Artificial Sequence
  Description of Artificial Sequence: Synthetic peptide
  Seed: KTWGQYWQVLGGPVSGLSIGTG (PMEL_HUMAN)
  Core: PVSGLSIGT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGXVSXLXIGXG

SEQ ID NO: 330031 - protein, 23 aa, Artificial Sequence
  Description of Artificial Sequence: Synthetic peptide
  Seed: KTWGQYWQVLGGPVSGLSIGTGR (PMEL_HUMAN)
  Core: GQYWQVLGG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KTWXQYXQXLGXPVSGLSIGTGR

SEQ ID NO: 330032 - protein, 23 aa, Artificial Sequence
  Description of Artificial Sequence: Synthetic peptide
  Seed: KTWGQYWQVLGGPVSGLSIGTGR (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSIGTGR

SEQ ID NO: 330033 - protein, 23 aa, Artificial Sequence
  Description of Artificial Sequence: Synthetic peptide
  Seed: KTWGQYWQVLGGPVSGLSIGTGR (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSIGTGR

SEQ ID NO: 330034 - protein, 23 aa, Artificial Sequence
  Description of Artificial Sequence: Synthetic peptide
  Seed: KTWGQYWQVLGGPVSGLSIGTGR (PMEL_HUMAN)
  Core: PVSGLSIGT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGXVSXLXIGXGR

SEQ ID NO: 330035 - protein, 23 aa, Artificial Sequence
  Description of Artificial Sequence: Synthetic peptide
  Seed: KTWGQYWQVLGGPVSGLSIGTGR (PMEL_HUMAN)
  Core: VSGLSIGTG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGPXSGXSXGTXR

SEQ ID NO: 330036 - protein, 24 aa, Artificial Sequence
  Description of Artificial Sequence: Synthetic peptide
  Seed: KTWGQYWQVLGGPVSGLSIGTGRA (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSIGTGRA

SEQ ID NO: 330037 - protein, 24 aa, Artificial Sequence
  Description of Artificial Sequence: Synthetic peptide
  Seed: KTWGQYWQVLGGPVSGLSIGTGRA (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSIGTGRA

SEQ ID NO: 330038 - protein, 24 aa, Artificial Sequence
  Description of Artificial Sequence: Synthetic peptide
  Seed: KTWGQYWQVLGGPVSGLSIGTGRA (PMEL_HUMAN)
  Core: PVSGLSIGT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGXVSXLXIGXGRA

SEQ ID NO: 330039 - protein, 24 aa, Artificial Sequence
  Description of Artificial Sequence: Synthetic peptide
  Seed: KTWGQYWQVLGGPVSGLSIGTGRA (PMEL_HUMAN)
  Core: VSGLSIGTG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGPXSGXSXGTXRA

SEQ ID NO: 330040 - protein, 25 aa, Artificial Sequence
  Description of Artificial Sequence: Synthetic peptide
  Seed: KTWGQYWQVLGGPVSGLSIGTGRAM (PMEL_HUMAN)
  Core: YWQVLGGPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQXWQXLXGPXSGLSIGTGRAM

SEQ ID NO: 330041 - protein, 25 aa, Artificial Sequence
  Description of Artificial Sequence: Synthetic peptide
  Seed: KTWGQYWQVLGGPVSGLSIGTGRAM (PMEL_HUMAN)
  Core: WQVLGGPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYXQVXGXPVXGLSIGTGRAM

SEQ ID NO: 330042 - protein, 25 aa, Artificial Sequence
  Description of Artificial Sequence: Synthetic peptide
  Seed: KTWGQYWQVLGGPVSGLSIGTGRAM (PMEL_HUMAN)
  Core: PVSGLSIGT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGXVSXLXIGXGRAM

SEQ ID NO: 330043 - protein, 25 aa, Artificial Sequence
  Description of Artificial Sequence: Synthetic peptide
  Seed: KTWGQYWQVLGGPVSGLSIGTGRAM (PMEL_HUMAN)
  Core: VSGLSIGTG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KTWGQYWQVLGGPXSGXSXGTXRAM

SEQ ID NO: 330044 - protein, 15 aa, Artificial Sequence
  Description of Artificial Sequence: Synthetic peptide
  Seed: KVLPDGQVIWVNNTI (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTX

SEQ ID NO: 330045 - protein, 16 aa, Artificial Sequence
  Description of Artificial Sequence: Synthetic peptide
  Seed: KVLPDGQVIWVNNTII (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXI

SEQ ID NO: 330046 - protein, 16 aa, Artificial Sequence
  Description of Artificial Sequence: Synthetic peptide
  Seed: KVLPDGQVIWVNNTII (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIX

SEQ ID NO: 330047 - protein, 17 aa, Artificial Sequence
  Description of Artificial Sequence: Synthetic peptide
  Seed: KVLPDGQVIWVNNTIIN (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXIN

SEQ ID NO: 330048 - protein, 17 aa, Artificial Sequence
  Description of Artificial Sequence: Synthetic peptide
  Seed: KVLPDGQVIWVNNTIIN (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXN

SEQ ID NO: 330049 - protein, 17 aa, Artificial Sequence
  Description of Artificial Sequence: Synthetic peptide
  Seed: KVLPDGQVIWVNNTIIN (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIX

SEQ ID NO: 330050 - protein, 18 aa, Artificial Sequence
  Description of Artificial Sequence: Synthetic peptide
  Seed: KVLPDGQVIWVNNTIING (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXING

SEQ ID NO: 330051 - protein, 18 aa, Artificial Sequence
  Description of Artificial Sequence: Synthetic peptide
  Seed: KVLPDGQVIWVNNTIING (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXG

SEQ ID NO: 330052 - protein, 19 aa, Artificial Sequence
  Description of Artificial Sequence: Synthetic peptide
  Seed: KVLPDGQVIWVNNTIINGS (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGS

SEQ ID NO: 330053 - protein, 19 aa, Artificial Sequence
  Description of Artificial Sequence: Synthetic peptide
  Seed: KVLPDGQVIWVNNTIINGS (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGS

SEQ ID NO: 330054 - protein, 19 aa, Artificial Sequence
  Description of Artificial Sequence: Synthetic peptide
  Seed: KVLPDGQVIWVNNTIINGS (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGS

SEQ ID NO: 330055 - protein, 20 aa, Artificial Sequence
  Description of Artificial Sequence: Synthetic peptide
  Seed: KVLPDGQVIWVNNTIINGSQ (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGSQ

SEQ ID NO: 330056 - protein, 20 aa, Artificial Sequence
  Description of Artificial Sequence: Synthetic peptide
  Seed: KVLPDGQVIWVNNTIINGSQ (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGSQ

SEQ ID NO: 330057 - protein, 20 aa, Artificial Sequence
  Description of Artificial Sequence: Synthetic peptide
  Seed: KVLPDGQVIWVNNTIINGSQ (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGSQ

SEQ ID NO: 330058 - protein, 20 aa, Artificial Sequence
  Description of Artificial Sequence: Synthetic peptide
  Seed: KVLPDGQVIWVNNTIINGSQ (PMEL_HUMAN)
  Core: VNNTIINGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVIWXNNXIXNGXQ

SEQ ID NO: 330059 - protein, 21 aa, Artificial Sequence
  Description of Artificial Sequence: Synthetic peptide
  Seed: KVLPDGQVIWVNNTIINGSQV (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGSQV

SEQ ID NO: 330060 - protein, 21 aa, Artificial Sequence
  Description of Artificial Sequence: Synthetic peptide
  Seed: KVLPDGQVIWVNNTIINGSQV (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGSQV

SEQ ID NO: 330061 - protein, 21 aa, Artificial Sequence
  Description of Artificial Sequence: Synthetic peptide
  Seed: KVLPDGQVIWVNNTIINGSQV (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGSQV

SEQ ID NO: 330062 - protein, 22 aa, Artificial Sequence
  Description of Artificial Sequence: Synthetic peptide
  Seed: KVLPDGQVIWVNNTIINGSQVW (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGSQVW

SEQ ID NO: 330063 - protein, 22 aa, Artificial Sequence
  Description of Artificial Sequence: Synthetic peptide
  Seed: KVLPDGQVIWVNNTIINGSQVW (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGSQVW

SEQ ID NO: 330064 - protein, 22 aa, Artificial Sequence
  Description of Artificial Sequence: Synthetic peptide
  Seed: KVLPDGQVIWVNNTIINGSQVW (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGSQVW

SEQ ID NO: 330065 - protein, 23 aa, Artificial Sequence
  Description of Artificial Sequence: Synthetic peptide
  Seed: KVLPDGQVIWVNNTIINGSQVWG (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGSQVWG

SEQ ID NO: 330066 - protein, 23 aa, Artificial Sequence
  Description of Artificial Sequence: Synthetic peptide
  Seed: KVLPDGQVIWVNNTIINGSQVWG (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGSQVWG

SEQ ID NO: 330067 - protein, 23 aa, Artificial Sequence
  Description of Artificial Sequence: Synthetic peptide
  Seed: KVLPDGQVIWVNNTIINGSQVWG (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGSQVWG

SEQ ID NO: 330068 - protein, 23 aa, Artificial Sequence
  Description of Artificial Sequence: Synthetic peptide
  Seed: KVLPDGQVIWVNNTIINGSQVWG (PMEL_HUMAN)
  Core: VNNTIINGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVIWXNNXIXNGXQVWG

SEQ ID NO: 330069 - protein, 24 aa, Artificial Sequence
  Description of Artificial Sequence: Synthetic peptide
  Seed: KVLPDGQVIWVNNTIINGSQVWGG (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGSQVWGG

SEQ ID NO: 330070 - protein, 24 aa, Artificial Sequence
  Description of Artificial Sequence: Synthetic peptide
  Seed: KVLPDGQVIWVNNTIINGSQVWGG (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGSQVWGG

SEQ ID NO: 330071 - protein, 24 aa, Artificial Sequence
  Description of Artificial Sequence: Synthetic peptide
  Seed: KVLPDGQVIWVNNTIINGSQVWGG (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGSQVWGG

SEQ ID NO: 330072 - protein, 24 aa, Artificial Sequence
  Description of Artificial Sequence: Synthetic peptide
  Seed: KVLPDGQVIWVNNTIINGSQVWGG (PMEL_HUMAN)
  Core: VNNTIINGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVIWXNNXIXNGXQVWGG

SEQ ID NO: 330073 - protein, 24 aa, Artificial Sequence
  Description of Artificial Sequence: Synthetic peptide
  Seed: KVLPDGQVIWVNNTIINGSQVWGG (PMEL_HUMAN)
  Core: INGSQVWGG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVIWVNNTIXNGXQXWGX

SEQ ID NO: 330074 - protein, 25 aa, Artificial Sequence
  Description of Artificial Sequence: Synthetic peptide
  Seed: KVLPDGQVIWVNNTIINGSQVWGGQ (PMEL_HUMAN)
  Core: QVIWVNNTI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGXVIXVXNTXINGSQVWGGQ

SEQ ID NO: 330075 - protein, 25 aa, Artificial Sequence
  Description of Artificial Sequence: Synthetic peptide
  Seed: KVLPDGQVIWVNNTIINGSQVWGGQ (PMEL_HUMAN)
  Core: VIWVNNTII
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQXIWXNXTIXNGSQVWGGQ

SEQ ID NO: 330076 - protein, 25 aa, Artificial Sequence
  Description of Artificial Sequence: Synthetic peptide
  Seed: KVLPDGQVIWVNNTIINGSQVWGGQ (PMEL_HUMAN)
  Core: IWVNNTIIN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVXWVXNXIIXGSQVWGGQ

SEQ ID NO: 330077 - protein, 25 aa, Artificial Sequence
  Description of Artificial Sequence: Synthetic peptide
  Seed: KVLPDGQVIWVNNTIINGSQVWGGQ (PMEL_HUMAN)
  Core: INGSQVWGG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
KVLPDGQVIWVNNTIXNGXQXWGXQ

SEQ ID NO: 330078 - protein, 17 aa, Artificial Sequence
  Description of Artificial Sequence: Synthetic peptide
  Seed: KVPRNQDWLGVSRQLRT (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXT

SEQ ID NO: 330079 - protein, 19 aa, Artificial Sequence
  Description of Artificial Sequence: Synthetic peptide
  Seed: KVPRNQDWLGVSRQLRTKA (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKA

SEQ ID NO: 330080 - protein, 20 aa, Artificial Sequence
  Description of Artificial Sequence: Synthetic peptide
  Seed: KVPRNQDWLGVSRQLRTKAW (PMEL_HUMAN)
  Core: RNQDWLGVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXNQXWXGVXRQLRTKAW

SEQ ID NO: 330081 - protein, 20 aa, Artificial Sequence
  Description of Artificial Sequence: Synthetic peptide
  Seed: KVPRNQDWLGVSRQLRTKAW (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKAW

SEQ ID NO: 330082 - protein, 20 aa, Artificial Sequence
  Description of Artificial Sequence: Synthetic peptide
  Seed: KVPRNQDWLGVSRQLRTKAW (PMEL_HUMAN)
  Core: LGVSRQLRT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDWXGVXRXLRXKAW

SEQ ID NO: 330083 - protein, 21 aa, Artificial Sequence
  Description of Artificial Sequence: Synthetic peptide
  Seed: KVPRNQDWLGVSRQLRTKAWN (PMEL_HUMAN)
  Core: RNQDWLGVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXNQXWXGVXRQLRTKAWN

SEQ ID NO: 330084 - protein, 21 aa, Artificial Sequence
  Description of Artificial Sequence: Synthetic peptide
  Seed: KVPRNQDWLGVSRQLRTKAWN (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKAWN

SEQ ID NO: 330085 - protein, 22 aa, Artificial Sequence
  Description of Artificial Sequence: Synthetic peptide
  Seed: KVPRNQDWLGVSRQLRTKAWNR (PMEL_HUMAN)
  Core: RNQDWLGVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXNQXWXGVXRQLRTKAWNR

SEQ ID NO: 330086 - protein, 22 aa, Artificial Sequence
  Description of Artificial Sequence: Synthetic peptide
  Seed: KVPRNQDWLGVSRQLRTKAWNR (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKAWNR

SEQ ID NO: 330087 - protein, 23 aa, Artificial Sequence
  Description of Artificial Sequence: Synthetic peptide
  Seed: KVPRNQDWLGVSRQLRTKAWNRQ (PMEL_HUMAN)
  Core: RNQDWLGVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXNQXWXGVXRQLRTKAWNRQ

SEQ ID NO: 330088 - protein, 23 aa, Artificial Sequence
  Description of Artificial Sequence: Synthetic peptide
  Seed: KVPRNQDWLGVSRQLRTKAWNRQ (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKAWNRQ

SEQ ID NO: 330089 - protein, 24 aa, Artificial Sequence
  Description of Artificial Sequence: Synthetic peptide
  Seed: KVPRNQDWLGVSRQLRTKAWNRQL (PMEL_HUMAN)
  Core: RNQDWLGVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXNQXWXGVXRQLRTKAWNRQL

SEQ ID NO: 330090 - protein, 24 aa, Artificial Sequence
  Description of Artificial Sequence: Synthetic peptide
  Seed: KVPRNQDWLGVSRQLRTKAWNRQL (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKAWNRQL

SEQ ID NO: 330091 - protein, 24 aa, Artificial Sequence
  Description of Artificial Sequence: Synthetic peptide
  Seed: KVPRNQDWLGVSRQLRTKAWNRQL (PMEL_HUMAN)
  Core: LGVSRQLRT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDWXGVXRXLRXKAWNRQL

SEQ ID NO: 330092 - protein, 24 aa, Artificial Sequence
  Description of Artificial Sequence: Synthetic peptide
  Seed: KVPRNQDWLGVSRQLRTKAWNRQL (PMEL_HUMAN)
  Core: LRTKAWNRQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDWLGVSRQXRTXAXNRXL

SEQ ID NO: 330093 - protein, 25 aa, Artificial Sequence
  Description of Artificial Sequence: Synthetic peptide
  Seed: KVPRNQDWLGVSRQLRTKAWNRQLY (PMEL_HUMAN)
  Core: RNQDWLGVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXNQXWXGVXRQLRTKAWNRQLY

SEQ ID NO: 330094 - protein, 25 aa, Artificial Sequence
  Description of Artificial Sequence: Synthetic peptide
  Seed: KVPRNQDWLGVSRQLRTKAWNRQLY (PMEL_HUMAN)
  Core: WLGVSRQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDXLGXSXQLXTKAWNRQLY

SEQ ID NO: 330095 - protein, 25 aa, Artificial Sequence
  Description of Artificial Sequence: Synthetic peptide
  Seed: KVPRNQDWLGVSRQLRTKAWNRQLY (PMEL_HUMAN)
  Core: LRTKAWNRQ
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
KVPRNQDWLGVSRQXRTXAXNRXLY

SEQ ID NO: 330096 - protein, 15 aa, Artificial Sequence
  Description of Artificial Sequence: Synthetic peptide
  Seed: KVPVSEVMGTTLAEM (PMEL_HUMAN)
  Core: VSEVMGTTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVPXSEXMXTTXAEM

SEQ ID NO: 330097 - protein, 15 aa, Artificial Sequence
  Description of Artificial Sequence: Synthetic peptide
  Seed: KVPVSEVMGTTLAEM (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEX

SEQ ID NO: 330098 - protein, 16 aa, Artificial Sequence
  Description of Artificial Sequence: Synthetic peptide
  Seed: KVPVSEVMGTTLAEMS (PMEL_HUMAN)
  Core: EVMGTTLAE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSXVMXTXLAXMS

SEQ ID NO: 330099 - protein, 16 aa, Artificial Sequence
  Description of Artificial Sequence: Synthetic peptide
  Seed: KVPVSEVMGTTLAEMS (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXS

SEQ ID NO: 330100 - protein, 17 aa, Artificial Sequence
  Description of Artificial Sequence: Synthetic peptide
  Seed: KVPVSEVMGTTLAEMST (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXST

SEQ ID NO: 330101 - protein, 17 aa, Artificial Sequence
  Description of Artificial Sequence: Synthetic peptide
  Seed: KVPVSEVMGTTLAEMST (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXT

SEQ ID NO: 330102 - protein, 18 aa, Artificial Sequence
  Description of Artificial Sequence: Synthetic peptide
  Seed: KVPVSEVMGTTLAEMSTP (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTP

SEQ ID NO: 330103 - protein, 19 aa, Artificial Sequence
  Description of Artificial Sequence: Synthetic peptide
  Seed: KVPVSEVMGTTLAEMSTPE (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPE

SEQ ID NO: 330104 - protein, 19 aa, Artificial Sequence
  Description of Artificial Sequence: Synthetic peptide
  Seed: KVPVSEVMGTTLAEMSTPE (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPE

SEQ ID NO: 330105 - protein, 20 aa, Artificial Sequence
  Description of Artificial Sequence: Synthetic peptide
  Seed: KVPVSEVMGTTLAEMSTPEA (PMEL_HUMAN)
  Core: EVMGTTLAE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSXVMXTXLAXMSTPEA

SEQ ID NO: 330106 - protein, 20 aa, Artificial Sequence
  Description of Artificial Sequence: Synthetic peptide
  Seed: KVPVSEVMGTTLAEMSTPEA (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPEA

SEQ ID NO: 330107 - protein, 20 aa, Artificial Sequence
  Description of Artificial Sequence: Synthetic peptide
  Seed: KVPVSEVMGTTLAEMSTPEA (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPEA

SEQ ID NO: 330108 - protein, 21 aa, Artificial Sequence
  Description of Artificial Sequence: Synthetic peptide
  Seed: KVPVSEVMGTTLAEMSTPEAT (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPEAT

SEQ ID NO: 330109 - protein, 21 aa, Artificial Sequence
  Description of Artificial Sequence: Synthetic peptide
  Seed: KVPVSEVMGTTLAEMSTPEAT (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPEAT

SEQ ID NO: 330110 - protein, 21 aa, Artificial Sequence
  Description of Artificial Sequence: Synthetic peptide
  Seed: KVPVSEVMGTTLAEMSTPEAT (PMEL_HUMAN)
  Core: LAEMSTPEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTXAEXSXPEXT

SEQ ID NO: 330111 - protein, 22 aa, Artificial Sequence
  Description of Artificial Sequence: Synthetic peptide
  Seed: KVPVSEVMGTTLAEMSTPEATG (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPEATG

SEQ ID NO: 330112 - protein, 22 aa, Artificial Sequence
  Description of Artificial Sequence: Synthetic peptide
  Seed: KVPVSEVMGTTLAEMSTPEATG (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPEATG

SEQ ID NO: 330113 - protein, 22 aa, Artificial Sequence
  Description of Artificial Sequence: Synthetic peptide
  Seed: KVPVSEVMGTTLAEMSTPEATG (PMEL_HUMAN)
  Core: LAEMSTPEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTXAEXSXPEXTG

SEQ ID NO: 330114 - protein, 23 aa, Artificial Sequence
  Description of Artificial Sequence: Synthetic peptide
  Seed: KVPVSEVMGTTLAEMSTPEATGM (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPEATGM

SEQ ID NO: 330115 - protein, 23 aa, Artificial Sequence
  Description of Artificial Sequence: Synthetic peptide
  Seed: KVPVSEVMGTTLAEMSTPEATGM (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPEATGM

SEQ ID NO: 330116 - protein, 23 aa, Artificial Sequence
  Description of Artificial Sequence: Synthetic peptide
  Seed: KVPVSEVMGTTLAEMSTPEATGM (PMEL_HUMAN)
  Core: LAEMSTPEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTXAEXSXPEXTGM

SEQ ID NO: 330117 - protein, 24 aa, Artificial Sequence
  Description of Artificial Sequence: Synthetic peptide
  Seed: KVPVSEVMGTTLAEMSTPEATGMT (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPEATGMT

SEQ ID NO: 330118 - protein, 24 aa, Artificial Sequence
  Description of Artificial Sequence: Synthetic peptide
  Seed: KVPVSEVMGTTLAEMSTPEATGMT (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPEATGMT

SEQ ID NO: 330119 - protein, 24 aa, Artificial Sequence
  Description of Artificial Sequence: Synthetic peptide
  Seed: KVPVSEVMGTTLAEMSTPEATGMT (PMEL_HUMAN)
  Core: LAEMSTPEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTXAEXSXPEXTGMT

SEQ ID NO: 330120 - protein, 24 aa, Artificial Sequence
  Description of Artificial Sequence: Synthetic peptide
  Seed: KVPVSEVMGTTLAEMSTPEATGMT (PMEL_HUMAN)
  Core: AEMSTPEAT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTLXEMXTXEAXGMT

SEQ ID NO: 330121 - protein, 25 aa, Artificial Sequence
  Description of Artificial Sequence: Synthetic peptide
  Seed: KVPVSEVMGTTLAEMSTPEATGMTP (PMEL_HUMAN)
  Core: VMGTTLAEM
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEXMGXTXAEXSTPEATGMTP

SEQ ID NO: 330122 - protein, 25 aa, Artificial Sequence
  Description of Artificial Sequence: Synthetic peptide
  Seed: KVPVSEVMGTTLAEMSTPEATGMTP (PMEL_HUMAN)
  Core: MGTTLAEMS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVXGTXLXEMXTPEATGMTP

SEQ ID NO: 330123 - protein, 25 aa, Artificial Sequence
  Description of Artificial Sequence: Synthetic peptide
  Seed: KVPVSEVMGTTLAEMSTPEATGMTP (PMEL_HUMAN)
  Core: LAEMSTPEA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTXAEXSXPEXTGMTP

SEQ ID NO: 330124 - protein, 25 aa, Artificial Sequence
  Description of Artificial Sequence: Synthetic peptide
  Seed: KVPVSEVMGTTLAEMSTPEATGMTP (PMEL_HUMAN)
  Core: AEMSTPEAT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KVPVSEVMGTTLXEMXTXEAXGMTP

SEQ ID NO: 330125 - protein, 15 aa, Artificial Sequence
  Description of Artificial Sequence: Synthetic peptide
  Seed: KVSNDGPTLIGANAS (PMEL_HUMAN)
  Core: NDGPTLIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVSXDGXTXIGXNAS

SEQ ID NO: 330126 - protein, 15 aa, Artificial Sequence
  Description of Artificial Sequence: Synthetic peptide
  Seed: KVSNDGPTLIGANAS (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAX

SEQ ID NO: 330127 - protein, 16 aa, Artificial Sequence
  Description of Artificial Sequence: Synthetic peptide
  Seed: KVSNDGPTLIGANASF (PMEL_HUMAN)
  Core: NDGPTLIGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
KVSXDGXTXIGXNASF

SEQ ID NO: 330128 - protein, 16 aa, Artificial Sequence
  Description of Artificial Sequence: Synthetic peptide
  Seed: KVSNDGPTLIGANASF (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXF

SEQ ID NO: 330129 - protein, 17 aa, Artificial Sequence
  Description of Artificial Sequence: Synthetic peptide
  Seed: KVSNDGPTLIGANASFS (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFS

SEQ ID NO: 330130 - protein, 17 aa, Artificial Sequence
  Description of Artificial Sequence: Synthetic peptide
  Seed: KVSNDGPTLIGANASFS (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFX

SEQ ID NO: 330131 - protein, 18 aa, Artificial Sequence
  Description of Artificial Sequence: Synthetic peptide
  Seed: KVSNDGPTLIGANASFSI (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSI

SEQ ID NO: 330132 - protein, 18 aa, Artificial Sequence
  Description of Artificial Sequence: Synthetic peptide
  Seed: KVSNDGPTLIGANASFSI (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXI

SEQ ID NO: 330133 - protein, 19 aa, Artificial Sequence
  Description of Artificial Sequence: Synthetic peptide
  Seed: KVSNDGPTLIGANASFSIA (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIA

SEQ ID NO: 330134 - protein, 19 aa, Artificial Sequence
  Description of Artificial Sequence: Synthetic peptide
  Seed: KVSNDGPTLIGANASFSIA (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIA

SEQ ID NO: 330135 - protein, 19 aa, Artificial Sequence
  Description of Artificial Sequence: Synthetic peptide
  Seed: KVSNDGPTLIGANASFSIA (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXA

SEQ ID NO: 330136 - protein, 20 aa, Artificial Sequence
  Description of Artificial Sequence: Synthetic peptide
  Seed: KVSNDGPTLIGANASFSIAL (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIAL

SEQ ID NO: 330137 - protein, 20 aa, Artificial Sequence
  Description of Artificial Sequence: Synthetic peptide
  Seed: KVSNDGPTLIGANASFSIAL (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIAL

SEQ ID NO: 330138 - protein, 20 aa, Artificial Sequence
  Description of Artificial Sequence: Synthetic peptide
  Seed: KVSNDGPTLIGANASFSIAL (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXAL

SEQ ID NO: 330139 - protein, 21 aa, Artificial Sequence
  Description of Artificial Sequence: Synthetic peptide
  Seed: KVSNDGPTLIGANASFSIALN (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIALN

SEQ ID NO: 330140 - protein, 21 aa, Artificial Sequence
  Description of Artificial Sequence: Synthetic peptide
  Seed: KVSNDGPTLIGANASFSIALN (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIALN

SEQ ID NO: 330141 - protein, 21 aa, Artificial Sequence
  Description of Artificial Sequence: Synthetic peptide
  Seed: KVSNDGPTLIGANASFSIALN (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXALN

SEQ ID NO: 330142 - protein, 22 aa, Artificial Sequence
  Description of Artificial Sequence: Synthetic peptide
  Seed: KVSNDGPTLIGANASFSIALNF (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIALNF

SEQ ID NO: 330143 - protein, 22 aa, Artificial Sequence
  Description of Artificial Sequence: Synthetic peptide
  Seed: KVSNDGPTLIGANASFSIALNF (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIALNF

SEQ ID NO: 330144 - protein, 22 aa, Artificial Sequence
  Description of Artificial Sequence: Synthetic peptide
  Seed: KVSNDGPTLIGANASFSIALNF (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXALNF

SEQ ID NO: 330145 - protein, 23 aa, Artificial Sequence
  Description of Artificial Sequence: Synthetic peptide
  Seed: KVSNDGPTLIGANASFSIALNFP (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIALNFP

SEQ ID NO: 330146 - protein, 23 aa, Artificial Sequence
  Description of Artificial Sequence: Synthetic peptide
  Seed: KVSNDGPTLIGANASFSIALNFP (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIALNFP

SEQ ID NO: 330147 - protein, 23 aa, Artificial Sequence
  Description of Artificial Sequence: Synthetic peptide
  Seed: KVSNDGPTLIGANASFSIALNFP (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXALNFP

SEQ ID NO: 330148 - protein, 23 aa, Artificial Sequence
  Description of Artificial Sequence: Synthetic peptide
  Seed: KVSNDGPTLIGANASFSIALNFP (PMEL_HUMAN)
  Core: NASFSIALN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLIGAXASXSXALXFP

SEQ ID NO: 330149 - protein, 24 aa, Artificial Sequence
  Description of Artificial Sequence: Synthetic peptide
  Seed: KVSNDGPTLIGANASFSIALNFPG (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIALNFPG

SEQ ID NO: 330150 - protein, 24 aa, Artificial Sequence
  Description of Artificial Sequence: Synthetic peptide
  Seed: KVSNDGPTLIGANASFSIALNFPG (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIALNFPG

SEQ ID NO: 330151 - protein, 24 aa, Artificial Sequence
  Description of Artificial Sequence: Synthetic peptide
  Seed: KVSNDGPTLIGANASFSIALNFPG (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXALNFPG

SEQ ID NO: 330152 - protein, 24 aa, Artificial Sequence
  Description of Artificial Sequence: Synthetic peptide
  Seed: KVSNDGPTLIGANASFSIALNFPG (PMEL_HUMAN)
  Core: NASFSIALN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLIGAXASXSXALXFPG

SEQ ID NO: 330153 - protein, 24 aa, Artificial Sequence
  Description of Artificial Sequence: Synthetic peptide
  Seed: KVSNDGPTLIGANASFSIALNFPG (PMEL_HUMAN)
  Core: FSIALNFPG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLIGANASXSIXLXFPX

SEQ ID NO: 330154 - protein, 25 aa, Artificial Sequence
  Description of Artificial Sequence: Synthetic peptide
  Seed: KVSNDGPTLIGANASFSIALNFPGS (PMEL_HUMAN)
  Core: PTLIGANAS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGXTLXGXNAXFSIALNFPGS

SEQ ID NO: 330155 - protein, 25 aa, Artificial Sequence
  Description of Artificial Sequence: Synthetic peptide
  Seed: KVSNDGPTLIGANASFSIALNFPGS (PMEL_HUMAN)
  Core: LIGANASFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTXIGXNXSFXIALNFPGS

SEQ ID NO: 330156 - protein, 25 aa, Artificial Sequence
  Description of Artificial Sequence: Synthetic peptide
  Seed: KVSNDGPTLIGANASFSIALNFPGS (PMEL_HUMAN)
  Core: IGANASFSI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLXGAXAXFSXALNFPGS

SEQ ID NO: 330157 - protein, 25 aa, Artificial Sequence
  Description of Artificial Sequence: Synthetic peptide
  Seed: KVSNDGPTLIGANASFSIALNFPGS (PMEL_HUMAN)
  Core: NASFSIALN
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLIGAXASXSXALXFPGS

SEQ ID NO: 330158 - protein, 25 aa, Artificial Sequence
  Description of Artificial Sequence: Synthetic peptide
  Seed: KVSNDGPTLIGANASFSIALNFPGS (PMEL_HUMAN)
  Core: ASFSIALNF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLIGANXSFXIXLNXPGS

SEQ ID NO: 330159 - protein, 25 aa, Artificial Sequence
  Description of Artificial Sequence: Synthetic peptide
  Seed: KVSNDGPTLIGANASFSIALNFPGS (PMEL_HUMAN)
  Core: FSIALNFPG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
KVSNDGPTLIGANASXSIXLXFPXS

SEQ ID NO: 330160 - protein, 13 aa, Artificial Sequence
  Description of Artificial Sequence: Synthetic peptide
  Seed: LADTNSLAVVSTQ (PMEL_HUMAN)
  Core: TNSLAVVST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LADXNSXAXVSXQ

SEQ ID NO: 330161 - protein, 13 aa, Artificial Sequence
  Description of Artificial Sequence: Synthetic peptide
  Seed: LADTNSLAVVSTQ (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTX

SEQ ID NO: 330162 - protein, 14 aa, Artificial Sequence
  Description of Artificial Sequence: Synthetic peptide
  Seed: LADTNSLAVVSTQL (PMEL_HUMAN)
  Core: TNSLAVVST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LADXNSXAXVSXQL

SEQ ID NO: 330163 - protein, 14 aa, Artificial Sequence
  Description of Artificial Sequence: Synthetic peptide
  Seed: LADTNSLAVVSTQL (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXL

SEQ ID NO: 330164 - protein, 15 aa, Artificial Sequence
  Description of Artificial Sequence: Synthetic peptide
  Seed: LADTNSLAVVSTQLI (PMEL_HUMAN)
  Core: TNSLAVVST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LADXNSXAXVSXQLI

SEQ ID NO: 330165 - protein, 15 aa, Artificial Sequence
  Description of Artificial Sequence: Synthetic peptide
  Seed: LADTNSLAVVSTQLI (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLI

SEQ ID NO: 330166 - protein, 15 aa, Artificial Sequence
  Description of Artificial Sequence: Synthetic peptide
  Seed: LADTNSLAVVSTQLI (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLX

SEQ ID NO: 330167 - protein, 16 aa, Artificial Sequence
  Description of Artificial Sequence: Synthetic peptide
  Seed: LADTNSLAVVSTQLIM (PMEL_HUMAN)
  Core: TNSLAVVST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LADXNSXAXVSXQLIM

SEQ ID NO: 330168 - protein, 16 aa, Artificial Sequence
  Description of Artificial Sequence: Synthetic peptide
  Seed: LADTNSLAVVSTQLIM (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIM

SEQ ID NO: 330169 - protein, 16 aa, Artificial Sequence
  Description of Artificial Sequence: Synthetic peptide
  Seed: LADTNSLAVVSTQLIM (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXM

SEQ ID NO: 330170 - protein, 17 aa, Artificial Sequence
  Description of Artificial Sequence: Synthetic peptide
  Seed: LADTNSLAVVSTQLIMP (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMP

SEQ ID NO: 330171 - protein, 17 aa, Artificial Sequence
  Description of Artificial Sequence: Synthetic peptide
  Seed: LADTNSLAVVSTQLIMP (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMP

SEQ ID NO: 330172 - protein, 18 aa, Artificial Sequence
  Description of Artificial Sequence: Synthetic peptide
  Seed: LADTNSLAVVSTQLIMPG (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPG

SEQ ID NO: 330173 - protein, 18 aa, Artificial Sequence
  Description of Artificial Sequence: Synthetic peptide
  Seed: LADTNSLAVVSTQLIMPG (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPG

SEQ ID NO: 330174 - protein, 19 aa, Artificial Sequence
  Description of Artificial Sequence: Synthetic peptide
  Seed: LADTNSLAVVSTQLIMPGQ (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQ

SEQ ID NO: 330175 - protein, 19 aa, Artificial Sequence
  Description of Artificial Sequence: Synthetic peptide
  Seed: LADTNSLAVVSTQLIMPGQ (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQ

SEQ ID NO: 330176 - protein, 19 aa, Artificial Sequence
  Description of Artificial Sequence: Synthetic peptide
  Seed: LADTNSLAVVSTQLIMPGQ (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQ

SEQ ID NO: 330177 - protein, 20 aa, Artificial Sequence
  Description of Artificial Sequence: Synthetic peptide
  Seed: LADTNSLAVVSTQLIMPGQE (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQE

SEQ ID NO: 330178 - protein, 20 aa, Artificial Sequence
  Description of Artificial Sequence: Synthetic peptide
  Seed: LADTNSLAVVSTQLIMPGQE (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQE

SEQ ID NO: 330179 - protein, 20 aa, Artificial Sequence
  Description of Artificial Sequence: Synthetic peptide
  Seed: LADTNSLAVVSTQLIMPGQE (PMEL_HUMAN)
  Core: VVSTQLIMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAXVSXQXIMXGQE

SEQ ID NO: 330180 - protein, 20 aa, Artificial Sequence
  Description of Artificial Sequence: Synthetic peptide
  Seed: LADTNSLAVVSTQLIMPGQE (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQE

SEQ ID NO: 330181 - protein, 21 aa, Artificial Sequence
  Description of Artificial Sequence: Synthetic peptide
  Seed: LADTNSLAVVSTQLIMPGQEA (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQEA

SEQ ID NO: 330182 - protein, 21 aa, Artificial Sequence
  Description of Artificial Sequence: Synthetic peptide
  Seed: LADTNSLAVVSTQLIMPGQEA (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQEA

SEQ ID NO: 330183 - protein, 21 aa, Artificial Sequence
  Description of Artificial Sequence: Synthetic peptide
  Seed: LADTNSLAVVSTQLIMPGQEA (PMEL_HUMAN)
  Core: VVSTQLIMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAXVSXQXIMXGQEA

SEQ ID NO: 330184 - protein, 21 aa, Artificial Sequence
  Description of Artificial Sequence: Synthetic peptide
  Seed: LADTNSLAVVSTQLIMPGQEA (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQEA

SEQ ID NO: 330185 - protein, 22 aa, Artificial Sequence
  Description of Artificial Sequence: Synthetic peptide
  Seed: LADTNSLAVVSTQLIMPGQEAG (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQEAG

SEQ ID NO: 330186 - protein, 22 aa, Artificial Sequence
  Description of Artificial Sequence: Synthetic peptide
  Seed: LADTNSLAVVSTQLIMPGQEAG (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQEAG

SEQ ID NO: 330187 - protein, 22 aa, Artificial Sequence
  Description of Artificial Sequence: Synthetic peptide
  Seed: LADTNSLAVVSTQLIMPGQEAG (PMEL_HUMAN)
  Core: VVSTQLIMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAXVSXQXIMXGQEAG

SEQ ID NO: 330188 - protein, 22 aa, Artificial Sequence
  Description of Artificial Sequence: Synthetic peptide
  Seed: LADTNSLAVVSTQLIMPGQEAG (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQEAG

SEQ ID NO: 330189 - protein, 23 aa, Artificial Sequence
  Description of Artificial Sequence: Synthetic peptide
  Seed: LADTNSLAVVSTQLIMPGQEAGL (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQEAGL

SEQ ID NO: 330190 - protein, 23 aa, Artificial Sequence
  Description of Artificial Sequence: Synthetic peptide
  Seed: LADTNSLAVVSTQLIMPGQEAGL (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQEAGL

SEQ ID NO: 330191 - protein, 23 aa, Artificial Sequence
  Description of Artificial Sequence: Synthetic peptide
  Seed: LADTNSLAVVSTQLIMPGQEAGL (PMEL_HUMAN)
  Core: VVSTQLIMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAXVSXQXIMXGQEAGL

SEQ ID NO: 330192 - protein, 23 aa, Artificial Sequence
  Description of Artificial Sequence: Synthetic peptide
  Seed: LADTNSLAVVSTQLIMPGQEAGL (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQEAGL

SEQ ID NO: 330193 - protein, 23 aa, Artificial Sequence
  Description of Artificial Sequence: Synthetic peptide
  Seed: LADTNSLAVVSTQLIMPGQEAGL (PMEL_HUMAN)
  Core: QLIMPGQEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVVSTXLIXPXQEXGL

SEQ ID NO: 330194 - protein, 24 aa, Artificial Sequence
  Description of Artificial Sequence: Synthetic peptide
  Seed: LADTNSLAVVSTQLIMPGQEAGLG (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQEAGLG

SEQ ID NO: 330195 - protein, 24 aa, Artificial Sequence
  Description of Artificial Sequence: Synthetic peptide
  Seed: LADTNSLAVVSTQLIMPGQEAGLG (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQEAGLG

SEQ ID NO: 330196 - protein, 24 aa, Artificial Sequence
  Description of Artificial Sequence: Synthetic peptide
  Seed: LADTNSLAVVSTQLIMPGQEAGLG (PMEL_HUMAN)
  Core: VVSTQLIMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAXVSXQXIMXGQEAGLG

SEQ ID NO: 330197 - protein, 24 aa, Artificial Sequence
  Description of Artificial Sequence: Synthetic peptide
  Seed: LADTNSLAVVSTQLIMPGQEAGLG (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQEAGLG

SEQ ID NO: 330198 - protein, 24 aa, Artificial Sequence
  Description of Artificial Sequence: Synthetic peptide
  Seed: LADTNSLAVVSTQLIMPGQEAGLG (PMEL_HUMAN)
  Core: QLIMPGQEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVVSTXLIXPXQEXGLG

SEQ ID NO: 330199 - protein, 25 aa, Artificial Sequence
  Description of Artificial Sequence: Synthetic peptide
  Seed: LADTNSLAVVSTQLIMPGQEAGLGQ (PMEL_HUMAN)
  Core: NSLAVVSTQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LADTXSLXVXSTXLIMPGQEAGLGQ

SEQ ID NO: 330200 - protein, 25 aa, Artificial Sequence
  Description of Artificial Sequence: Synthetic peptide
  Seed: LADTNSLAVVSTQLIMPGQEAGLGQ (PMEL_HUMAN)
  Core: LAVVSTQLI
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSXAVXSXQLXMPGQEAGLGQ

SEQ ID NO: 330201 - protein, 25 aa, Artificial Sequence
  Description of Artificial Sequence: Synthetic peptide
  Seed: LADTNSLAVVSTQLIMPGQEAGLGQ (PMEL_HUMAN)
  Core: VVSTQLIMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAXVSXQXIMXGQEAGLGQ

SEQ ID NO: 330202 - protein, 25 aa, Artificial Sequence
  Description of Artificial Sequence: Synthetic peptide
  Seed: LADTNSLAVVSTQLIMPGQEAGLGQ (PMEL_HUMAN)
  Core: VSTQLIMPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVXSTXLXMPXQEAGLGQ

SEQ ID NO: 330203 - protein, 25 aa, Artificial Sequence
  Description of Artificial Sequence: Synthetic peptide
  Seed: LADTNSLAVVSTQLIMPGQEAGLGQ (PMEL_HUMAN)
  Core: QLIMPGQEA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LADTNSLAVVSTXLIXPXQEXGLGQ

SEQ ID NO: 330204 - protein, 15 aa, Artificial Sequence
  Description of Artificial Sequence: Synthetic peptide
  Seed: LAEADLSYTWDFGDS (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXS

SEQ ID NO: 330205 - protein, 16 aa, Artificial Sequence
  Description of Artificial Sequence: Synthetic peptide
  Seed: LAEADLSYTWDFGDSS (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSS

SEQ ID NO: 330206 - protein, 17 aa, Artificial Sequence
  Description of Artificial Sequence: Synthetic peptide
  Seed: LAEADLSYTWDFGDSSG (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSG

SEQ ID NO: 330207 - protein, 19 aa, Artificial Sequence
  Description of Artificial Sequence: Synthetic peptide
  Seed: LAEADLSYTWDFGDSSGTL (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTL

SEQ ID NO: 330208 - protein, 20 aa, Artificial Sequence
  Description of Artificial Sequence: Synthetic peptide
  Seed: LAEADLSYTWDFGDSSGTLI (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTLI

SEQ ID NO: 330209 - protein, 21 aa, Artificial Sequence
  Description of Artificial Sequence: Synthetic peptide
  Seed: LAEADLSYTWDFGDSSGTLIS (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTLIS

SEQ ID NO: 330210 - protein, 22 aa, Artificial Sequence
  Description of Artificial Sequence: Synthetic peptide
  Seed: LAEADLSYTWDFGDSSGTLISR (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTLISR

SEQ ID NO: 330211 - protein, 23 aa, Artificial Sequence
  Description of Artificial Sequence: Synthetic peptide
  Seed: LAEADLSYTWDFGDSSGTLISRA (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTLISRA

SEQ ID NO: 330212 - protein, 23 aa, Artificial Sequence
  Description of Artificial Sequence: Synthetic peptide
  Seed: LAEADLSYTWDFGDSSGTLISRA (PMEL_HUMAN)
  Core: WDFGDSSGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAEADLSYTXDFXDXSGXLISRA

SEQ ID NO: 330213 - protein, 23 aa, Artificial Sequence
  Description of Artificial Sequence: Synthetic peptide
  Seed: LAEADLSYTWDFGDSSGTLISRA (PMEL_HUMAN)
  Core: SSGTLISRA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LAEADLSYTWDFGDXSGXLXSRX

SEQ ID NO: 330214 - protein, 24 aa, Artificial Sequence
  Description of Artificial Sequence: Synthetic peptide
  Seed: LAEADLSYTWDFGDSSGTLISRAL (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTLISRAL

SEQ ID NO: 330215 - protein, 24 aa, Artificial Sequence
  Description of Artificial Sequence: Synthetic peptide
  Seed: LAEADLSYTWDFGDSSGTLISRAL (PMEL_HUMAN)
  Core: WDFGDSSGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAEADLSYTXDFXDXSGXLISRAL

SEQ ID NO: 330216 - protein, 24 aa, Artificial Sequence
  Description of Artificial Sequence: Synthetic peptide
  Seed: LAEADLSYTWDFGDSSGTLISRAL (PMEL_HUMAN)
  Core: SSGTLISRA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LAEADLSYTWDFGDXSGXLXSRXL

SEQ ID NO: 330217 - protein, 25 aa, Artificial Sequence
  Description of Artificial Sequence: Synthetic peptide
  Seed: LAEADLSYTWDFGDSSGTLISRALV (PMEL_HUMAN)
  Core: LSYTWDFGD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAEADXSYXWXFGXSSGTLISRALV

SEQ ID NO: 330218 - protein, 25 aa, Artificial Sequence
  Description of Artificial Sequence: Synthetic peptide
  Seed: LAEADLSYTWDFGDSSGTLISRALV (PMEL_HUMAN)
  Core: WDFGDSSGT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAEADLSYTXDFXDXSGXLISRALV

SEQ ID NO: 330219 - protein, 25 aa, Artificial Sequence
  Description of Artificial Sequence: Synthetic peptide
  Seed: LAEADLSYTWDFGDSSGTLISRALV (PMEL_HUMAN)
  Core: SSGTLISRA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LAEADLSYTWDFGDXSGXLXSRXLV

SEQ ID NO: 330220 - protein, 13 aa, Artificial Sequence
  Description of Artificial Sequence: Synthetic peptide
  Seed: LAEMSTPEATGMT (PMEL_HUMAN)
  Core: AEMSTPEAT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXEMXTXEAXGMT

SEQ ID NO: 330221 - protein, 14 aa, Artificial Sequence
  Description of Artificial Sequence: Synthetic peptide
  Seed: LAEMSTPEATGMTP (PMEL_HUMAN)
  Core: AEMSTPEAT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXEMXTXEAXGMTP

SEQ ID NO: 330222 - protein, 15 aa, Artificial Sequence
  Description of Artificial Sequence: Synthetic peptide
  Seed: LAEMSTPEATGMTPA (PMEL_HUMAN)
  Core: AEMSTPEAT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXEMXTXEAXGMTPA

SEQ ID NO: 330223 - protein, 15 aa, Artificial Sequence
  Description of Artificial Sequence: Synthetic peptide
  Seed: LAEMSTPEATGMTPA (PMEL_HUMAN)
  Core: MSTPEATGM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAEXSTXEXTGXTPA

SEQ ID NO: 330224 - protein, 16 aa, Artificial Sequence
  Description of Artificial Sequence: Synthetic peptide
  Seed: LAEMSTPEATGMTPAE (PMEL_HUMAN)
  Core: AEMSTPEAT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXEMXTXEAXGMTPAE

SEQ ID NO: 330225 - protein, 16 aa, Artificial Sequence
  Description of Artificial Sequence: Synthetic peptide
  Seed: LAEMSTPEATGMTPAE (PMEL_HUMAN)
  Core: PEATGMTPA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTXEAXGXTPXE

SEQ ID NO: 330226 - protein, 16 aa, Artificial Sequence
  Description of Artificial Sequence: Synthetic peptide
  Seed: LAEMSTPEATGMTPAE (PMEL_HUMAN)
  Core: EATGMTPAE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPXATXMXPAX

SEQ ID NO: 330227 - protein, 17 aa, Artificial Sequence
  Description of Artificial Sequence: Synthetic peptide
  Seed: LAEMSTPEATGMTPAEV (PMEL_HUMAN)
  Core: PEATGMTPA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTXEAXGXTPXEV

SEQ ID NO: 330228 - protein, 17 aa, Artificial Sequence
  Description of Artificial Sequence: Synthetic peptide
  Seed: LAEMSTPEATGMTPAEV (PMEL_HUMAN)
  Core: EATGMTPAE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPXATXMXPAXV

SEQ ID NO: 330229 - protein, 17 aa, Artificial Sequence
  Description of Artificial Sequence: Synthetic peptide
  Seed: LAEMSTPEATGMTPAEV (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEX

SEQ ID NO: 330230 - protein, 18 aa, Artificial Sequence
  Description of Artificial Sequence: Synthetic peptide
  Seed: LAEMSTPEATGMTPAEVS (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXS

SEQ ID NO: 330231 - protein, 19 aa, Artificial Sequence
  Description of Artificial Sequence: Synthetic peptide
  Seed: LAEMSTPEATGMTPAEVSI (PMEL_HUMAN)
  Core: EATGMTPAE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPXATXMXPAXVSI

SEQ ID NO: 330232 - protein, 19 aa, Artificial Sequence
  Description of Artificial Sequence: Synthetic peptide
  Seed: LAEMSTPEATGMTPAEVSI (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSI

SEQ ID NO: 330233 - protein, 20 aa, Artificial Sequence
  Description of Artificial Sequence: Synthetic peptide
  Seed: LAEMSTPEATGMTPAEVSIV (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSIV

SEQ ID NO: 330234 - protein, 21 aa, Artificial Sequence
  Description of Artificial Sequence: Synthetic peptide
  Seed: LAEMSTPEATGMTPAEVSIVV (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSIVV

SEQ ID NO: 330235 - protein, 21 aa, Artificial Sequence
  Description of Artificial Sequence: Synthetic peptide
  Seed: LAEMSTPEATGMTPAEVSIVV (PMEL_HUMAN)
  Core: MTPAEVSIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEATGXTPXEXSIXV

SEQ ID NO: 330236 - protein, 22 aa, Artificial Sequence
  Description of Artificial Sequence: Synthetic peptide
  Seed: LAEMSTPEATGMTPAEVSIVVL (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSIVVL

SEQ ID NO: 330237 - protein, 22 aa, Artificial Sequence
  Description of Artificial Sequence: Synthetic peptide
  Seed: LAEMSTPEATGMTPAEVSIVVL (PMEL_HUMAN)
  Core: MTPAEVSIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEATGXTPXEXSIXVL

SEQ ID NO: 330238 - protein, 23 aa, Artificial Sequence
  Description of Artificial Sequence: Synthetic peptide
  Seed: LAEMSTPEATGMTPAEVSIVVLS (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSIVVLS

SEQ ID NO: 330239 - protein, 23 aa, Artificial Sequence
  Description of Artificial Sequence: Synthetic peptide
  Seed: LAEMSTPEATGMTPAEVSIVVLS (PMEL_HUMAN)
  Core: MTPAEVSIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEATGXTPXEXSIXVLS

SEQ ID NO: 330240 - protein, 24 aa, Artificial Sequence
  Description of Artificial Sequence: Synthetic peptide
  Seed: LAEMSTPEATGMTPAEVSIVVLSG (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSIVVLSG

SEQ ID NO: 330241 - protein, 24 aa, Artificial Sequence
  Description of Artificial Sequence: Synthetic peptide
  Seed: LAEMSTPEATGMTPAEVSIVVLSG (PMEL_HUMAN)
  Core: MTPAEVSIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEATGXTPXEXSIXVLSG

SEQ ID NO: 330242 - protein, 25 aa, Artificial Sequence
  Description of Artificial Sequence: Synthetic peptide
  Seed: LAEMSTPEATGMTPAEVSIVVLSGT (PMEL_HUMAN)
  Core: ATGMTPAEV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEXTGXTXAEXSIVVLSGT

SEQ ID NO: 330243 - protein, 25 aa, Artificial Sequence
  Description of Artificial Sequence: Synthetic peptide
  Seed: LAEMSTPEATGMTPAEVSIVVLSGT (PMEL_HUMAN)
  Core: MTPAEVSIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LAEMSTPEATGXTPXEXSIXVLSGT

SEQ ID NO: 330244 - protein, 13 aa, Artificial Sequence
  Description of Artificial Sequence: Synthetic peptide
  Seed: LAHSSSAFTITDQ (PMEL_HUMAN)
  Core: AHSSSAFTI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXHSXSXFTXTDQ

SEQ ID NO: 330245 - protein, 14 aa, Artificial Sequence
  Description of Artificial Sequence: Synthetic peptide
  Seed: LAHSSSAFTITDQV (PMEL_HUMAN)
  Core: AHSSSAFTI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXHSXSXFTXTDQV

SEQ ID NO: 330246 - protein, 14 aa, Artificial Sequence
  Description of Artificial Sequence: Synthetic peptide
  Seed: LAHSSSAFTITDQV (PMEL_HUMAN)
  Core: SSSAFTITD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAHXSSXFXITXQV

SEQ ID NO: 330247 - protein, 15 aa, Artificial Sequence
  Description of Artificial Sequence: Synthetic peptide
  Seed: LAHSSSAFTITDQVP (PMEL_HUMAN)
  Core: AHSSSAFTI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXHSXSXFTXTDQVP

SEQ ID NO: 330248 - protein, 15 aa, Artificial Sequence
  Description of Artificial Sequence: Synthetic peptide
  Seed: LAHSSSAFTITDQVP (PMEL_HUMAN)
  Core: SSSAFTITD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAHXSSXFXITXQVP

SEQ ID NO: 330249 - protein, 15 aa, Artificial Sequence
  Description of Artificial Sequence: Synthetic peptide
  Seed: LAHSSSAFTITDQVP (PMEL_HUMAN)
  Core: SSAFTITDQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LAHSXSAXTXTDXVP

SEQ ID NO: 330250 - protein, 15 aa, Artificial Sequence
  Description of Artificial Sequence: Synthetic peptide
  Seed: LAHSSSAFTITDQVP (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXP

SEQ ID NO: 330251 - protein, 16 aa, Artificial Sequence
  Description of Artificial Sequence: Synthetic peptide
  Seed: LAHSSSAFTITDQVPF (PMEL_HUMAN)
  Core: AHSSSAFTI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXHSXSXFTXTDQVPF

SEQ ID NO: 330252 - protein, 16 aa, Artificial Sequence
  Description of Artificial Sequence: Synthetic peptide
  Seed: LAHSSSAFTITDQVPF (PMEL_HUMAN)
  Core: HSSSAFTIT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXSSXAXTIXDQVPF

SEQ ID NO: 330253 - protein, 16 aa, Artificial Sequence
  Description of Artificial Sequence: Synthetic peptide
  Seed: LAHSSSAFTITDQVPF (PMEL_HUMAN)
  Core: SSSAFTITD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAHXSSXFXITXQVPF

SEQ ID NO: 330254 - protein, 16 aa, Artificial Sequence
  Description of Artificial Sequence: Synthetic peptide
  Seed: LAHSSSAFTITDQVPF (PMEL_HUMAN)
  Core: SSAFTITDQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LAHSXSAXTXTDXVPF

SEQ ID NO: 330255 - protein, 16 aa, Artificial Sequence
  Description of Artificial Sequence: Synthetic peptide
  Seed: LAHSSSAFTITDQVPF (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPF

SEQ ID NO: 330256 - protein, 16 aa, Artificial Sequence
  Description of Artificial Sequence: Synthetic peptide
  Seed: LAHSSSAFTITDQVPF (PMEL_HUMAN)
  Core: AFTITDQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSXFTXTXQVXF

SEQ ID NO: 330257 - protein, 16 aa, Artificial Sequence
  Description of Artificial Sequence: Synthetic peptide
  Seed: LAHSSSAFTITDQVPF (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPX

SEQ ID NO: 330258 - protein, 17 aa, Artificial Sequence
  Description of Artificial Sequence: Synthetic peptide
  Seed: LAHSSSAFTITDQVPFS (PMEL_HUMAN)
  Core: SSAFTITDQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LAHSXSAXTXTDXVPFS

SEQ ID NO: 330259 - protein, 17 aa, Artificial Sequence
  Description of Artificial Sequence: Synthetic peptide
  Seed: LAHSSSAFTITDQVPFS (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFS

SEQ ID NO: 330260 - protein, 17 aa, Artificial Sequence
  Description of Artificial Sequence: Synthetic peptide
  Seed: LAHSSSAFTITDQVPFS (PMEL_HUMAN)
  Core: AFTITDQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSXFTXTXQVXFS

SEQ ID NO: 330261 - protein, 17 aa, Artificial Sequence
  Description of Artificial Sequence: Synthetic peptide
  Seed: LAHSSSAFTITDQVPFS (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXS

SEQ ID NO: 330262 - protein, 18 aa, Artificial Sequence
  Description of Artificial Sequence: Synthetic peptide
  Seed: LAHSSSAFTITDQVPFSV (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSV

SEQ ID NO: 330263 - protein, 18 aa, Artificial Sequence
  Description of Artificial Sequence: Synthetic peptide
  Seed: LAHSSSAFTITDQVPFSV (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSV

SEQ ID NO: 330264 - protein, 19 aa, Artificial Sequence
  Description of Artificial Sequence: Synthetic peptide
  Seed: LAHSSSAFTITDQVPFSVS (PMEL_HUMAN)
  Core: SSAFTITDQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LAHSXSAXTXTDXVPFSVS

SEQ ID NO: 330265 - protein, 19 aa, Artificial Sequence
  Description of Artificial Sequence: Synthetic peptide
  Seed: LAHSSSAFTITDQVPFSVS (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVS

SEQ ID NO: 330266 - protein, 19 aa, Artificial Sequence
  Description of Artificial Sequence: Synthetic peptide
  Seed: LAHSSSAFTITDQVPFSVS (PMEL_HUMAN)
  Core: AFTITDQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSXFTXTXQVXFSVS

SEQ ID NO: 330267 - protein, 19 aa, Artificial Sequence
  Description of Artificial Sequence: Synthetic peptide
  Seed: LAHSSSAFTITDQVPFSVS (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVS

SEQ ID NO: 330268 - protein, 19 aa, Artificial Sequence
  Description of Artificial Sequence: Synthetic peptide
  Seed: LAHSSSAFTITDQVPFSVS (PMEL_HUMAN)
  Core: TITDQVPFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFXITXQXPFXVS

SEQ ID NO: 330269 - protein, 19 aa, Artificial Sequence
  Description of Artificial Sequence: Synthetic peptide
  Seed: LAHSSSAFTITDQVPFSVS (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXS

SEQ ID NO: 330270 - protein, 20 aa, Artificial Sequence
  Description of Artificial Sequence: Synthetic peptide
  Seed: LAHSSSAFTITDQVPFSVSV (PMEL_HUMAN)
  Core: SSAFTITDQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LAHSXSAXTXTDXVPFSVSV

SEQ ID NO: 330271 - protein, 20 aa, Artificial Sequence
  Description of Artificial Sequence: Synthetic peptide
  Seed: LAHSSSAFTITDQVPFSVSV (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVSV

SEQ ID NO: 330272 - protein, 20 aa, Artificial Sequence
  Description of Artificial Sequence: Synthetic peptide
  Seed: LAHSSSAFTITDQVPFSVSV (PMEL_HUMAN)
  Core: AFTITDQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSXFTXTXQVXFSVSV

SEQ ID NO: 330273 - protein, 20 aa, Artificial Sequence
  Description of Artificial Sequence: Synthetic peptide
  Seed: LAHSSSAFTITDQVPFSVSV (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVSV

SEQ ID NO: 330274 - protein, 20 aa, Artificial Sequence
  Description of Artificial Sequence: Synthetic peptide
  Seed: LAHSSSAFTITDQVPFSVSV (PMEL_HUMAN)
  Core: TITDQVPFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFXITXQXPFXVSV

SEQ ID NO: 330275 - protein, 20 aa, Artificial Sequence
  Description of Artificial Sequence: Synthetic peptide
  Seed: LAHSSSAFTITDQVPFSVSV (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXSV

SEQ ID NO: 330276 - protein, 21 aa, Artificial Sequence
  Description of Artificial Sequence: Synthetic peptide
  Seed: LAHSSSAFTITDQVPFSVSVS (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVSVS

SEQ ID NO: 330277 - protein, 21 aa, Artificial Sequence
  Description of Artificial Sequence: Synthetic peptide
  Seed: LAHSSSAFTITDQVPFSVSVS (PMEL_HUMAN)
  Core: AFTITDQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSXFTXTXQVXFSVSVS

SEQ ID NO: 330278 - protein, 21 aa, Artificial Sequence
  Description of Artificial Sequence: Synthetic peptide
  Seed: LAHSSSAFTITDQVPFSVSVS (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVSVS

SEQ ID NO: 330279 - protein, 21 aa, Artificial Sequence
  Description of Artificial Sequence: Synthetic peptide
  Seed: LAHSSSAFTITDQVPFSVSVS (PMEL_HUMAN)
  Core: TITDQVPFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFXITXQXPFXVSVS

SEQ ID NO: 330280 - protein, 21 aa, Artificial Sequence
  Description of Artificial Sequence: Synthetic peptide
  Seed: LAHSSSAFTITDQVPFSVSVS (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXSVS

SEQ ID NO: 330281 - protein, 22 aa, Artificial Sequence
  Description of Artificial Sequence: Synthetic peptide
  Seed: LAHSSSAFTITDQVPFSVSVSQ (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVSVSQ

SEQ ID NO: 330282 - protein, 22 aa, Artificial Sequence
  Description of Artificial Sequence: Synthetic peptide
  Seed: LAHSSSAFTITDQVPFSVSVSQ (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVSVSQ

SEQ ID NO: 330283 - protein, 22 aa, Artificial Sequence
  Description of Artificial Sequence: Synthetic peptide
  Seed: LAHSSSAFTITDQVPFSVSVSQ (PMEL_HUMAN)
  Core: TITDQVPFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFXITXQXPFXVSVSQ

SEQ ID NO: 330284 - protein, 22 aa, Artificial Sequence
  Description of Artificial Sequence: Synthetic peptide
  Seed: LAHSSSAFTITDQVPFSVSVSQ (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXSVSQ

SEQ ID NO: 330285 - protein, 22 aa, Artificial Sequence
  Description of Artificial Sequence: Synthetic peptide
  Seed: LAHSSSAFTITDQVPFSVSVSQ (PMEL_HUMAN)
  Core: QVPFSVSVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDXVPXSXSVXQ

SEQ ID NO: 330286 - protein, 23 aa, Artificial Sequence
  Description of Artificial Sequence: Synthetic peptide
  Seed: LAHSSSAFTITDQVPFSVSVSQL (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVSVSQL

SEQ ID NO: 330287 - protein, 23 aa, Artificial Sequence
  Description of Artificial Sequence: Synthetic peptide
  Seed: LAHSSSAFTITDQVPFSVSVSQL (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVSVSQL

SEQ ID NO: 330288 - protein, 23 aa, Artificial Sequence
  Description of Artificial Sequence: Synthetic peptide
  Seed: LAHSSSAFTITDQVPFSVSVSQL (PMEL_HUMAN)
  Core: TITDQVPFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFXITXQXPFXVSVSQL

SEQ ID NO: 330289 - protein, 23 aa, Artificial Sequence
  Description of Artificial Sequence: Synthetic peptide
  Seed: LAHSSSAFTITDQVPFSVSVSQL (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXSVSQL

SEQ ID NO: 330290 - protein, 23 aa, Artificial Sequence
  Description of Artificial Sequence: Synthetic peptide
  Seed: LAHSSSAFTITDQVPFSVSVSQL (PMEL_HUMAN)
  Core: QVPFSVSVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDXVPXSXSVXQL

SEQ ID NO: 330291 - protein, 24 aa, Artificial Sequence
  Description of Artificial Sequence: Synthetic peptide
  Seed: LAHSSSAFTITDQVPFSVSVSQLR (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVSVSQLR

SEQ ID NO: 330292 - protein, 24 aa, Artificial Sequence
  Description of Artificial Sequence: Synthetic peptide
  Seed: LAHSSSAFTITDQVPFSVSVSQLR (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVSVSQLR

SEQ ID NO: 330293 - protein, 24 aa, Artificial Sequence
  Description of Artificial Sequence: Synthetic peptide
  Seed: LAHSSSAFTITDQVPFSVSVSQLR (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXSVSQLR

SEQ ID NO: 330294 - protein, 24 aa, Artificial Sequence
  Description of Artificial Sequence: Synthetic peptide
  Seed: LAHSSSAFTITDQVPFSVSVSQLR (PMEL_HUMAN)
  Core: QVPFSVSVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDXVPXSXSVXQLR

SEQ ID NO: 330295 - protein, 24 aa, Artificial Sequence
  Description of Artificial Sequence: Synthetic peptide
  Seed: LAHSSSAFTITDQVPFSVSVSQLR (PMEL_HUMAN)
  Core: PFSVSVSQL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDQVXFSXSXSQXR

SEQ ID NO: 330296 - protein, 25 aa, Artificial Sequence
  Description of Artificial Sequence: Synthetic peptide
  Seed: LAHSSSAFTITDQVPFSVSVSQLRA (PMEL_HUMAN)
  Core: SAFTITDQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSXAFXIXDQXPFSVSVSQLRA

SEQ ID NO: 330297 - protein, 25 aa, Artificial Sequence
  Description of Artificial Sequence: Synthetic peptide
  Seed: LAHSSSAFTITDQVPFSVSVSQLRA (PMEL_HUMAN)
  Core: FTITDQVPF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAXTIXDXVPXSVSVSQLRA

SEQ ID NO: 330298 - protein, 25 aa, Artificial Sequence
  Description of Artificial Sequence: Synthetic peptide
  Seed: LAHSSSAFTITDQVPFSVSVSQLRA (PMEL_HUMAN)
  Core: ITDQVPFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTXTDXVXFSXSVSQLRA

SEQ ID NO: 330299 - protein, 25 aa, Artificial Sequence
  Description of Artificial Sequence: Synthetic peptide
  Seed: LAHSSSAFTITDQVPFSVSVSQLRA (PMEL_HUMAN)
  Core: QVPFSVSVS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDXVPXSXSVXQLRA

SEQ ID NO: 330300 - protein, 25 aa, Artificial Sequence
  Description of Artificial Sequence: Synthetic peptide
  Seed: LAHSSSAFTITDQVPFSVSVSQLRA (PMEL_HUMAN)
  Core: PFSVSVSQL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDQVXFSXSXSQXRA

SEQ ID NO: 330301 - protein, 25 aa, Artificial Sequence
  Description of Artificial Sequence: Synthetic peptide
  Seed: LAHSSSAFTITDQVPFSVSVSQLRA (PMEL_HUMAN)
  Core: FSVSVSQLR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
LAHSSSAFTITDQVPXSVXVXQLXA

SEQ ID NO: 330302 - protein, 13 aa, Artificial Sequence
  Description of Artificial Sequence: Synthetic peptide
  Seed: LASLIYRRRLMKQ (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQ

SEQ ID NO: 330303 - protein, 13 aa, Artificial Sequence
  Description of Artificial Sequence: Synthetic peptide
  Seed: LASLIYRRRLMKQ (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKX

SEQ ID NO: 330304 - protein, 14 aa, Artificial Sequence
  Description of Artificial Sequence: Synthetic peptide
  Seed: LASLIYRRRLMKQD (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQD

SEQ ID NO: 330305 - protein, 14 aa, Artificial Sequence
  Description of Artificial Sequence: Synthetic peptide
  Seed: LASLIYRRRLMKQD (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXD

SEQ ID NO: 330306 - protein, 15 aa, Artificial Sequence
  Description of Artificial Sequence: Synthetic peptide
  Seed: LASLIYRRRLMKQDF (PMEL_HUMAN)
  Core: SLIYRRRLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXLIXRXRLXKQDF

SEQ ID NO: 330307 - protein, 15 aa, Artificial Sequence
  Description of Artificial Sequence: Synthetic peptide
  Seed: LASLIYRRRLMKQDF (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDF

SEQ ID NO: 330308 - protein, 15 aa, Artificial Sequence
  Description of Artificial Sequence: Synthetic peptide
  Seed: LASLIYRRRLMKQDF (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDF

SEQ ID NO: 330309 - protein, 15 aa, Artificial Sequence
  Description of Artificial Sequence: Synthetic peptide
  Seed: LASLIYRRRLMKQDF (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXF

SEQ ID NO: 330310 - protein, 16 aa, Artificial Sequence
  Description of Artificial Sequence: Synthetic peptide
  Seed: LASLIYRRRLMKQDFS (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFS

SEQ ID NO: 330311 - protein, 16 aa, Artificial Sequence
  Description of Artificial Sequence: Synthetic peptide
  Seed: LASLIYRRRLMKQDFS (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFS

SEQ ID NO: 330312 - protein, 16 aa, Artificial Sequence
  Description of Artificial Sequence: Synthetic peptide
  Seed: LASLIYRRRLMKQDFS (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFS

SEQ ID NO: 330313 - protein, 17 aa, Artificial Sequence
  Description of Artificial Sequence: Synthetic peptide
  Seed: LASLIYRRRLMKQDFSV (PMEL_HUMAN)
  Core: SLIYRRRLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXLIXRXRLXKQDFSV

SEQ ID NO: 330314 - protein, 17 aa, Artificial Sequence
  Description of Artificial Sequence: Synthetic peptide
  Seed: LASLIYRRRLMKQDFSV (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSV

SEQ ID NO: 330315 - protein, 17 aa, Artificial Sequence
  Description of Artificial Sequence: Synthetic peptide
  Seed: LASLIYRRRLMKQDFSV (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSV

SEQ ID NO: 330316 - protein, 17 aa, Artificial Sequence
  Description of Artificial Sequence: Synthetic peptide
  Seed: LASLIYRRRLMKQDFSV (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSV

SEQ ID NO: 330317 - protein, 18 aa, Artificial Sequence
  Description of Artificial Sequence: Synthetic peptide
  Seed: LASLIYRRRLMKQDFSVP (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVP

SEQ ID NO: 330318 - protein, 18 aa, Artificial Sequence
  Description of Artificial Sequence: Synthetic peptide
  Seed: LASLIYRRRLMKQDFSVP (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVP

SEQ ID NO: 330319 - protein, 18 aa, Artificial Sequence
  Description of Artificial Sequence: Synthetic peptide
  Seed: LASLIYRRRLMKQDFSVP (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVP

SEQ ID NO: 330320 - protein, 19 aa, Artificial Sequence
  Description of Artificial Sequence: Synthetic peptide
  Seed: LASLIYRRRLMKQDFSVPQ (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQ

SEQ ID NO: 330321 - protein, 19 aa, Artificial Sequence
  Description of Artificial Sequence: Synthetic peptide
  Seed: LASLIYRRRLMKQDFSVPQ (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQ

SEQ ID NO: 330322 - protein, 19 aa, Artificial Sequence
  Description of Artificial Sequence: Synthetic peptide
  Seed: LASLIYRRRLMKQDFSVPQ (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQ

SEQ ID NO: 330323 - protein, 19 aa, Artificial Sequence
  Description of Artificial Sequence: Synthetic peptide
  Seed: LASLIYRRRLMKQDFSVPQ (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQ

SEQ ID NO: 330324 - protein, 19 aa, Artificial Sequence
  Description of Artificial Sequence: Synthetic peptide
  Seed: LASLIYRRRLMKQDFSVPQ (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQ

SEQ ID NO: 330325 - protein, 20 aa, Artificial Sequence
  Description of Artificial Sequence: Synthetic peptide
  Seed: LASLIYRRRLMKQDFSVPQL (PMEL_HUMAN)
  Core: SLIYRRRLM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXLIXRXRLXKQDFSVPQL

SEQ ID NO: 330326 - protein, 20 aa, Artificial Sequence
  Description of Artificial Sequence: Synthetic peptide
  Seed: LASLIYRRRLMKQDFSVPQL (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQL

SEQ ID NO: 330327 - protein, 20 aa, Artificial Sequence
  Description of Artificial Sequence: Synthetic peptide
  Seed: LASLIYRRRLMKQDFSVPQL (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQL

SEQ ID NO: 330328 - protein, 20 aa, Artificial Sequence
  Description of Artificial Sequence: Synthetic peptide
  Seed: LASLIYRRRLMKQDFSVPQL (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQL

SEQ ID NO: 330329 - protein, 20 aa, Artificial Sequence
  Description of Artificial Sequence: Synthetic peptide
  Seed: LASLIYRRRLMKQDFSVPQL (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQL

SEQ ID NO: 330330 - protein, 20 aa, Artificial Sequence
  Description of Artificial Sequence: Synthetic peptide
  Seed: LASLIYRRRLMKQDFSVPQL (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQL

SEQ ID NO: 330331 - protein, 20 aa, Artificial Sequence
  Description of Artificial Sequence: Synthetic peptide
  Seed: LASLIYRRRLMKQDFSVPQL (PMEL_HUMAN)
  Core: LMKQDFSVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRXMKXDXSVXQL

SEQ ID NO: 330332 - protein, 20 aa, Artificial Sequence
  Description of Artificial Sequence: Synthetic peptide
  Seed: LASLIYRRRLMKQDFSVPQL (PMEL_HUMAN)
  Core: MKQDFSVPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLXKQXFXVPXL

SEQ ID NO: 330333 - protein, 21 aa, Artificial Sequence
  Description of Artificial Sequence: Synthetic peptide
  Seed: LASLIYRRRLMKQDFSVPQLP (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQLP

SEQ ID NO: 330334 - protein, 21 aa, Artificial Sequence
  Description of Artificial Sequence: Synthetic peptide
  Seed: LASLIYRRRLMKQDFSVPQLP (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQLP

SEQ ID NO: 330335 - protein, 21 aa, Artificial Sequence
  Description of Artificial Sequence: Synthetic peptide
  Seed: LASLIYRRRLMKQDFSVPQLP (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQLP

SEQ ID NO: 330336 - protein, 21 aa, Artificial Sequence
  Description of Artificial Sequence: Synthetic peptide
  Seed: LASLIYRRRLMKQDFSVPQLP (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQLP

SEQ ID NO: 330337 - protein, 21 aa, Artificial Sequence
  Description of Artificial Sequence: Synthetic peptide
  Seed: LASLIYRRRLMKQDFSVPQLP (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQLP

SEQ ID NO: 330338 - protein, 21 aa, Artificial Sequence
  Description of Artificial Sequence: Synthetic peptide
  Seed: LASLIYRRRLMKQDFSVPQLP (PMEL_HUMAN)
  Core: LMKQDFSVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRXMKXDXSVXQLP

SEQ ID NO: 330339 - protein, 21 aa, Artificial Sequence
  Description of Artificial Sequence: Synthetic peptide
  Seed: LASLIYRRRLMKQDFSVPQLP (PMEL_HUMAN)
  Core: MKQDFSVPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLXKQXFXVPXLP

SEQ ID NO: 330340 - protein, 22 aa, Artificial Sequence
  Description of Artificial Sequence: Synthetic peptide
  Seed: LASLIYRRRLMKQDFSVPQLPH (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQLPH

SEQ ID NO: 330341 - protein, 22 aa, Artificial Sequence
  Description of Artificial Sequence: Synthetic peptide
  Seed: LASLIYRRRLMKQDFSVPQLPH (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQLPH

SEQ ID NO: 330342 - protein, 22 aa, Artificial Sequence
  Description of Artificial Sequence: Synthetic peptide
  Seed: LASLIYRRRLMKQDFSVPQLPH (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQLPH

SEQ ID NO: 330343 - protein, 22 aa, Artificial Sequence
  Description of Artificial Sequence: Synthetic peptide
  Seed: LASLIYRRRLMKQDFSVPQLPH (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQLPH

SEQ ID NO: 330344 - protein, 22 aa, Artificial Sequence
  Description of Artificial Sequence: Synthetic peptide
  Seed: LASLIYRRRLMKQDFSVPQLPH (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQLPH

SEQ ID NO: 330345 - protein, 22 aa, Artificial Sequence
  Description of Artificial Sequence: Synthetic peptide
  Seed: LASLIYRRRLMKQDFSVPQLPH (PMEL_HUMAN)
  Core: LMKQDFSVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRXMKXDXSVXQLPH

SEQ ID NO: 330346 - protein, 22 aa, Artificial Sequence
  Description of Artificial Sequence: Synthetic peptide
  Seed: LASLIYRRRLMKQDFSVPQLPH (PMEL_HUMAN)
  Core: MKQDFSVPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLXKQXFXVPXLPH

SEQ ID NO: 330347 - protein, 23 aa, Artificial Sequence
  Description of Artificial Sequence: Synthetic peptide
  Seed: LASLIYRRRLMKQDFSVPQLPHS (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQLPHS

SEQ ID NO: 330348 - protein, 23 aa, Artificial Sequence
  Description of Artificial Sequence: Synthetic peptide
  Seed: LASLIYRRRLMKQDFSVPQLPHS (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQLPHS

SEQ ID NO: 330349 - protein, 23 aa, Artificial Sequence
  Description of Artificial Sequence: Synthetic peptide
  Seed: LASLIYRRRLMKQDFSVPQLPHS (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQLPHS

SEQ ID NO: 330350 - protein, 23 aa, Artificial Sequence
  Description of Artificial Sequence: Synthetic peptide
  Seed: LASLIYRRRLMKQDFSVPQLPHS (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQLPHS

SEQ ID NO: 330351 - protein, 23 aa, Artificial Sequence
  Description of Artificial Sequence: Synthetic peptide
  Seed: LASLIYRRRLMKQDFSVPQLPHS (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQLPHS

SEQ ID NO: 330352 - protein, 23 aa, Artificial Sequence
  Description of Artificial Sequence: Synthetic peptide
  Seed: LASLIYRRRLMKQDFSVPQLPHS (PMEL_HUMAN)
  Core: LMKQDFSVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRXMKXDXSVXQLPHS

SEQ ID NO: 330353 - protein, 23 aa, Artificial Sequence
  Description of Artificial Sequence: Synthetic peptide
  Seed: LASLIYRRRLMKQDFSVPQLPHS (PMEL_HUMAN)
  Core: MKQDFSVPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLXKQXFXVPXLPHS

SEQ ID NO: 330354 - protein, 24 aa, Artificial Sequence
  Description of Artificial Sequence: Synthetic peptide
  Seed: LASLIYRRRLMKQDFSVPQLPHSS (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQLPHSS

SEQ ID NO: 330355 - protein, 24 aa, Artificial Sequence
  Description of Artificial Sequence: Synthetic peptide
  Seed: LASLIYRRRLMKQDFSVPQLPHSS (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQLPHSS

SEQ ID NO: 330356 - protein, 24 aa, Artificial Sequence
  Description of Artificial Sequence: Synthetic peptide
  Seed: LASLIYRRRLMKQDFSVPQLPHSS (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQLPHSS

SEQ ID NO: 330357 - protein, 24 aa, Artificial Sequence
  Description of Artificial Sequence: Synthetic peptide
  Seed: LASLIYRRRLMKQDFSVPQLPHSS (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQLPHSS

SEQ ID NO: 330358 - protein, 24 aa, Artificial Sequence
  Description of Artificial Sequence: Synthetic peptide
  Seed: LASLIYRRRLMKQDFSVPQLPHSS (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQLPHSS

SEQ ID NO: 330359 - protein, 24 aa, Artificial Sequence
  Description of Artificial Sequence: Synthetic peptide
  Seed: LASLIYRRRLMKQDFSVPQLPHSS (PMEL_HUMAN)
  Core: LMKQDFSVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRXMKXDXSVXQLPHSS

SEQ ID NO: 330360 - protein, 24 aa, Artificial Sequence
  Description of Artificial Sequence: Synthetic peptide
  Seed: LASLIYRRRLMKQDFSVPQLPHSS (PMEL_HUMAN)
  Core: MKQDFSVPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLXKQXFXVPXLPHSS

SEQ ID NO: 330361 - protein, 24 aa, Artificial Sequence
  Description of Artificial Sequence: Synthetic peptide
  Seed: LASLIYRRRLMKQDFSVPQLPHSS (PMEL_HUMAN)
  Core: KQDFSVPQL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLMXQDXSXPQXPHSS

SEQ ID NO: 330362 - protein, 24 aa, Artificial Sequence
  Description of Artificial Sequence: Synthetic peptide
  Seed: LASLIYRRRLMKQDFSVPQLPHSS (PMEL_HUMAN)
  Core: FSVPQLPHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLMKQDXSVXQXPHXS

SEQ ID NO: 330363 - protein, 25 aa, Artificial Sequence
  Description of Artificial Sequence: Synthetic peptide
  Seed: LASLIYRRRLMKQDFSVPQLPHSSS (PMEL_HUMAN)
  Core: LIYRRRLMK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LASXIYXRXLMXQDFSVPQLPHSSS

SEQ ID NO: 330364 - protein, 25 aa, Artificial Sequence
  Description of Artificial Sequence: Synthetic peptide
  Seed: LASLIYRRRLMKQDFSVPQLPHSSS (PMEL_HUMAN)
  Core: IYRRRLMKQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LASLXYRXRXMKXDFSVPQLPHSSS

SEQ ID NO: 330365 - protein, 25 aa, Artificial Sequence
  Description of Artificial Sequence: Synthetic peptide
  Seed: LASLIYRRRLMKQDFSVPQLPHSSS (PMEL_HUMAN)
  Core: YRRRLMKQD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LASLIXRRXLXKQXFSVPQLPHSSS

SEQ ID NO: 330366 - protein, 25 aa, Artificial Sequence
  Description of Artificial Sequence: Synthetic peptide
  Seed: LASLIYRRRLMKQDFSVPQLPHSSS (PMEL_HUMAN)
  Core: RRLMKQDFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRXRLXKXDFXVPQLPHSSS

SEQ ID NO: 330367 - protein, 25 aa, Artificial Sequence
  Description of Artificial Sequence: Synthetic peptide
  Seed: LASLIYRRRLMKQDFSVPQLPHSSS (PMEL_HUMAN)
  Core: RLMKQDFSV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRXLMXQXFSXPQLPHSSS

SEQ ID NO: 330368 - protein, 25 aa, Artificial Sequence
  Description of Artificial Sequence: Synthetic peptide
  Seed: LASLIYRRRLMKQDFSVPQLPHSSS (PMEL_HUMAN)
  Core: LMKQDFSVP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRXMKXDXSVXQLPHSSS

SEQ ID NO: 330369 - protein, 25 aa, Artificial Sequence
  Description of Artificial Sequence: Synthetic peptide
  Seed: LASLIYRRRLMKQDFSVPQLPHSSS (PMEL_HUMAN)
  Core: MKQDFSVPQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLXKQXFXVPXLPHSSS

SEQ ID NO: 330370 - protein, 25 aa, Artificial Sequence
  Description of Artificial Sequence: Synthetic peptide
  Seed: LASLIYRRRLMKQDFSVPQLPHSSS (PMEL_HUMAN)
  Core: FSVPQLPHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LASLIYRRRLMKQDXSVXQXPHXSS

SEQ ID NO: 330371 - protein, 14 aa, Artificial Sequence
  Description of Artificial Sequence: Synthetic peptide
  Seed: LAVGATKVPRNQDW (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDW

SEQ ID NO: 330372 - protein, 15 aa, Artificial Sequence
  Description of Artificial Sequence: Synthetic peptide
  Seed: LAVGATKVPRNQDWL (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDWL

SEQ ID NO: 330373 - protein, 16 aa, Artificial Sequence
  Description of Artificial Sequence: Synthetic peptide
  Seed: LAVGATKVPRNQDWLG (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDWLG

SEQ ID NO: 330374 - protein, 17 aa, Artificial Sequence
  Description of Artificial Sequence: Synthetic peptide
  Seed: LAVGATKVPRNQDWLGV (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDWLGV

SEQ ID NO: 330375 - protein, 20 aa, Artificial Sequence
  Description of Artificial Sequence: Synthetic peptide
  Seed: LAVGATKVPRNQDWLGVSRQ (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDWLGVSRQ

SEQ ID NO: 330376 - protein, 23 aa, Artificial Sequence
  Description of Artificial Sequence: Synthetic peptide
  Seed: LAVGATKVPRNQDWLGVSRQLRT (PMEL_HUMAN)
  Core: WLGVSRQLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LAVGATKVPRNQDXLGXSXQLXT

SEQ ID NO: 330377 - protein, 24 aa, Artificial Sequence
  Description of Artificial Sequence: Synthetic peptide
  Seed: LAVGATKVPRNQDWLGVSRQLRTK (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDWLGVSRQLRTK

SEQ ID NO: 330378 - protein, 24 aa, Artificial Sequence
  Description of Artificial Sequence: Synthetic peptide
  Seed: LAVGATKVPRNQDWLGVSRQLRTK (PMEL_HUMAN)
  Core: WLGVSRQLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LAVGATKVPRNQDXLGXSXQLXTK

SEQ ID NO: 330379 - protein, 25 aa, Artificial Sequence
  Description of Artificial Sequence: Synthetic peptide
  Seed: LAVGATKVPRNQDWLGVSRQLRTKA (PMEL_HUMAN)
  Core: VGATKVPRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXGAXKXPRXQDWLGVSRQLRTKA

SEQ ID NO: 330380 - protein, 25 aa, Artificial Sequence
  Description of Artificial Sequence: Synthetic peptide
  Seed: LAVGATKVPRNQDWLGVSRQLRTKA (PMEL_HUMAN)
  Core: RNQDWLGVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVGATKVPXNQXWXGVXRQLRTKA

SEQ ID NO: 330381 - protein, 25 aa, Artificial Sequence
  Description of Artificial Sequence: Synthetic peptide
  Seed: LAVGATKVPRNQDWLGVSRQLRTKA (PMEL_HUMAN)
  Core: WLGVSRQLR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LAVGATKVPRNQDXLGXSXQLXTKA

SEQ ID NO: 330382 - protein, 13 aa, Artificial Sequence
  Description of Artificial Sequence: Synthetic peptide
  Seed: LAVIGALLAVGAT (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXAT

SEQ ID NO: 330383 - protein, 13 aa, Artificial Sequence
  Description of Artificial Sequence: Synthetic peptide
  Seed: LAVIGALLAVGAT (PMEL_HUMAN)
  Core: IGALLAVGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXGAXLXVGXT

SEQ ID NO: 330384 - protein, 14 aa, Artificial Sequence
  Description of Artificial Sequence: Synthetic peptide
  Seed: LAVIGALLAVGATK (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXATK

SEQ ID NO: 330385 - protein, 14 aa, Artificial Sequence
  Description of Artificial Sequence: Synthetic peptide
  Seed: LAVIGALLAVGATK (PMEL_HUMAN)
  Core: IGALLAVGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXGAXLXVGXTK

SEQ ID NO: 330386 - protein, 15 aa, Artificial Sequence
  Description of Artificial Sequence: Synthetic peptide
  Seed: LAVIGALLAVGATKV (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXATKV

SEQ ID NO: 330387 - protein, 15 aa, Artificial Sequence
  Description of Artificial Sequence: Synthetic peptide
  Seed: LAVIGALLAVGATKV (PMEL_HUMAN)
  Core: IGALLAVGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXGAXLXVGXTKV

SEQ ID NO: 330388 - protein, 15 aa, Artificial Sequence
  Description of Artificial Sequence: Synthetic peptide
  Seed: LAVIGALLAVGATKV (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKX

SEQ ID NO: 330389 - protein, 16 aa, Artificial Sequence
  Description of Artificial Sequence: Synthetic peptide
  Seed: LAVIGALLAVGATKVP (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXATKVP

SEQ ID NO: 330390 - protein, 16 aa, Artificial Sequence
  Description of Artificial Sequence: Synthetic peptide
  Seed: LAVIGALLAVGATKVP (PMEL_HUMAN)
  Core: IGALLAVGA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXGAXLXVGXTKVP

SEQ ID NO: 330391 - protein, 16 aa, Artificial Sequence
  Description of Artificial Sequence: Synthetic peptide
  Seed: LAVIGALLAVGATKVP (PMEL_HUMAN)
  Core: ALLAVGATK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGXLLXVXATXVP

SEQ ID NO: 330392 - protein, 16 aa, Artificial Sequence
  Description of Artificial Sequence: Synthetic peptide
  Seed: LAVIGALLAVGATKVP (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXP

SEQ ID NO: 330393 - protein, 17 aa, Artificial Sequence
  Description of Artificial Sequence: Synthetic peptide
  Seed: LAVIGALLAVGATKVPR (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXATKVPR

SEQ ID NO: 330394 - protein, 17 aa, Artificial Sequence
  Description of Artificial Sequence: Synthetic peptide
  Seed: LAVIGALLAVGATKVPR (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPR

SEQ ID NO: 330395 - protein, 18 aa, Artificial Sequence
  Description of Artificial Sequence: Synthetic peptide
  Seed: LAVIGALLAVGATKVPRN (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXATKVPRN

SEQ ID NO: 330396 - protein, 18 aa, Artificial Sequence
  Description of Artificial Sequence: Synthetic peptide
  Seed: LAVIGALLAVGATKVPRN (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRN

SEQ ID NO: 330397 - protein, 19 aa, Artificial Sequence
  Description of Artificial Sequence: Synthetic peptide
  Seed: LAVIGALLAVGATKVPRNQ (PMEL_HUMAN)
  Core: VIGALLAVG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXIGXLXAVXATKVPRNQ

SEQ ID NO: 330398 - protein, 19 aa, Artificial Sequence
  Description of Artificial Sequence: Synthetic peptide
  Seed: LAVIGALLAVGATKVPRNQ (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQ

SEQ ID NO: 330399 - protein, 19 aa, Artificial Sequence
  Description of Artificial Sequence: Synthetic peptide
  Seed: LAVIGALLAVGATKVPRNQ (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQ

SEQ ID NO: 330400 - protein, 20 aa, Artificial Sequence
  Description of Artificial Sequence: Synthetic peptide
  Seed: LAVIGALLAVGATKVPRNQD (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQD

SEQ ID NO: 330401 - protein, 20 aa, Artificial Sequence
  Description of Artificial Sequence: Synthetic peptide
  Seed: LAVIGALLAVGATKVPRNQD (PMEL_HUMAN)
  Core: AVGATKVPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLXVGXTXVPXNQD

SEQ ID NO: 330402 - protein, 20 aa, Artificial Sequence
  Description of Artificial Sequence: Synthetic peptide
  Seed: LAVIGALLAVGATKVPRNQD (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQD

SEQ ID NO: 330403 - protein, 21 aa, Artificial Sequence
  Description of Artificial Sequence: Synthetic peptide
  Seed: LAVIGALLAVGATKVPRNQDW (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQDW

SEQ ID NO: 330404 - protein, 21 aa, Artificial Sequence
  Description of Artificial Sequence: Synthetic peptide
  Seed: LAVIGALLAVGATKVPRNQDW (PMEL_HUMAN)
  Core: AVGATKVPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLXVGXTXVPXNQDW

SEQ ID NO: 330405 - protein, 21 aa, Artificial Sequence
  Description of Artificial Sequence: Synthetic peptide
  Seed: LAVIGALLAVGATKVPRNQDW (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQDW

SEQ ID NO: 330406 - protein, 22 aa, Artificial Sequence
  Description of Artificial Sequence: Synthetic peptide
  Seed: LAVIGALLAVGATKVPRNQDWL (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQDWL

SEQ ID NO: 330407 - protein, 22 aa, Artificial Sequence
  Description of Artificial Sequence: Synthetic peptide
  Seed: LAVIGALLAVGATKVPRNQDWL (PMEL_HUMAN)
  Core: AVGATKVPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLXVGXTXVPXNQDWL

SEQ ID NO: 330408 - protein, 22 aa, Artificial Sequence
  Description of Artificial Sequence: Synthetic peptide
  Seed: LAVIGALLAVGATKVPRNQDWL (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQDWL

SEQ ID NO: 330409 - protein, 23 aa, Artificial Sequence
  Description of Artificial Sequence: Synthetic peptide
  Seed: LAVIGALLAVGATKVPRNQDWLG (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQDWLG

SEQ ID NO: 330410 - protein, 23 aa, Artificial Sequence
  Description of Artificial Sequence: Synthetic peptide
  Seed: LAVIGALLAVGATKVPRNQDWLG (PMEL_HUMAN)
  Core: AVGATKVPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLXVGXTXVPXNQDWLG

SEQ ID NO: 330411 - protein, 23 aa, Artificial Sequence
  Description of Artificial Sequence: Synthetic peptide
  Seed: LAVIGALLAVGATKVPRNQDWLG (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQDWLG

SEQ ID NO: 330412 - protein, 24 aa, Artificial Sequence
  Description of Artificial Sequence: Synthetic peptide
  Seed: LAVIGALLAVGATKVPRNQDWLGV (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQDWLGV

SEQ ID NO: 330413 - protein, 24 aa, Artificial Sequence
  Description of Artificial Sequence: Synthetic peptide
  Seed: LAVIGALLAVGATKVPRNQDWLGV (PMEL_HUMAN)
  Core: AVGATKVPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLXVGXTXVPXNQDWLGV

SEQ ID NO: 330414 - protein, 24 aa, Artificial Sequence
  Description of Artificial Sequence: Synthetic peptide
  Seed: LAVIGALLAVGATKVPRNQDWLGV (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQDWLGV

SEQ ID NO: 330415 - protein, 25 aa, Artificial Sequence
  Description of Artificial Sequence: Synthetic peptide
  Seed: LAVIGALLAVGATKVPRNQDWLGVS (PMEL_HUMAN)
  Core: LLAVGATKV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGAXLAXGXTKXPRNQDWLGVS

SEQ ID NO: 330416 - protein, 25 aa, Artificial Sequence
  Description of Artificial Sequence: Synthetic peptide
  Seed: LAVIGALLAVGATKVPRNQDWLGVS (PMEL_HUMAN)
  Core: AVGATKVPR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLXVGXTXVPXNQDWLGVS

SEQ ID NO: 330417 - protein, 25 aa, Artificial Sequence
  Description of Artificial Sequence: Synthetic peptide
  Seed: LAVIGALLAVGATKVPRNQDWLGVS (PMEL_HUMAN)
  Core: VGATKVPRN
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LAVIGALLAXGAXKXPRXQDWLGVS

SEQ ID NO: 330418 - protein, 13 aa, Artificial Sequence
  Description of Artificial Sequence: Synthetic peptide
  Seed: LAVVSTQLIMPGQ (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQ

SEQ ID NO: 330419 - protein, 13 aa, Artificial Sequence
  Description of Artificial Sequence: Synthetic peptide
  Seed: LAVVSTQLIMPGQ (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQ

SEQ ID NO: 330420 - protein, 14 aa, Artificial Sequence
  Description of Artificial Sequence: Synthetic peptide
  Seed: LAVVSTQLIMPGQE (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQE

SEQ ID NO: 330421 - protein, 14 aa, Artificial Sequence
  Description of Artificial Sequence: Synthetic peptide
  Seed: LAVVSTQLIMPGQE (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQE

SEQ ID NO: 330422 - protein, 15 aa, Artificial Sequence
  Description of Artificial Sequence: Synthetic peptide
  Seed: LAVVSTQLIMPGQEA (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQEA

SEQ ID NO: 330423 - protein, 15 aa, Artificial Sequence
  Description of Artificial Sequence: Synthetic peptide
  Seed: LAVVSTQLIMPGQEA (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEA

SEQ ID NO: 330424 - protein, 15 aa, Artificial Sequence
  Description of Artificial Sequence: Synthetic peptide
  Seed: LAVVSTQLIMPGQEA (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEX

SEQ ID NO: 330425 - protein, 16 aa, Artificial Sequence
  Description of Artificial Sequence: Synthetic peptide
  Seed: LAVVSTQLIMPGQEAG (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQEAG

SEQ ID NO: 330426 - protein, 16 aa, Artificial Sequence
  Description of Artificial Sequence: Synthetic peptide
  Seed: LAVVSTQLIMPGQEAG (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAG

SEQ ID NO: 330427 - protein, 16 aa, Artificial Sequence
  Description of Artificial Sequence: Synthetic peptide
  Seed: LAVVSTQLIMPGQEAG (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXG

SEQ ID NO: 330428 - protein, 17 aa, Artificial Sequence
  Description of Artificial Sequence: Synthetic peptide
  Seed: LAVVSTQLIMPGQEAGL (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQEAGL

SEQ ID NO: 330429 - protein, 17 aa, Artificial Sequence
  Description of Artificial Sequence: Synthetic peptide
  Seed: LAVVSTQLIMPGQEAGL (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGL

SEQ ID NO: 330430 - protein, 17 aa, Artificial Sequence
  Description of Artificial Sequence: Synthetic peptide
  Seed: LAVVSTQLIMPGQEAGL (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGL

SEQ ID NO: 330431 - protein, 18 aa, Artificial Sequence
  Description of Artificial Sequence: Synthetic peptide
  Seed: LAVVSTQLIMPGQEAGLG (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLG

SEQ ID NO: 330432 - protein, 19 aa, Artificial Sequence
  Description of Artificial Sequence: Synthetic peptide
  Seed: LAVVSTQLIMPGQEAGLGQ (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQEAGLGQ

SEQ ID NO: 330433 - protein, 19 aa, Artificial Sequence
  Description of Artificial Sequence: Synthetic peptide
  Seed: LAVVSTQLIMPGQEAGLGQ (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQ

SEQ ID NO: 330434 - protein, 19 aa, Artificial Sequence
  Description of Artificial Sequence: Synthetic peptide
  Seed: LAVVSTQLIMPGQEAGLGQ (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQ

SEQ ID NO: 330435 - protein, 20 aa, Artificial Sequence
  Description of Artificial Sequence: Synthetic peptide
  Seed: LAVVSTQLIMPGQEAGLGQV (PMEL_HUMAN)
  Core: VVSTQLIMP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LAXVSXQXIMXGQEAGLGQV

SEQ ID NO: 330436 - protein, 20 aa, Artificial Sequence
  Description of Artificial Sequence: Synthetic peptide
  Seed: LAVVSTQLIMPGQEAGLGQV (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQV

SEQ ID NO: 330437 - protein, 20 aa, Artificial Sequence
  Description of Artificial Sequence: Synthetic peptide
  Seed: LAVVSTQLIMPGQEAGLGQV (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQV

SEQ ID NO: 330438 - protein, 20 aa, Artificial Sequence
  Description of Artificial Sequence: Synthetic peptide
  Seed: LAVVSTQLIMPGQEAGLGQV (PMEL_HUMAN)
  Core: IMPGQEAGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTQLXMPXQXAGXGQV

SEQ ID NO: 330439 - protein, 21 aa, Artificial Sequence
  Description of Artificial Sequence: Synthetic peptide
  Seed: LAVVSTQLIMPGQEAGLGQVP (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQVP

SEQ ID NO: 330440 - protein, 21 aa, Artificial Sequence
  Description of Artificial Sequence: Synthetic peptide
  Seed: LAVVSTQLIMPGQEAGLGQVP (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQVP

SEQ ID NO: 330441 - protein, 22 aa, Artificial Sequence
  Description of Artificial Sequence: Synthetic peptide
  Seed: LAVVSTQLIMPGQEAGLGQVPL (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQVPL

SEQ ID NO: 330442 - protein, 22 aa, Artificial Sequence
  Description of Artificial Sequence: Synthetic peptide
  Seed: LAVVSTQLIMPGQEAGLGQVPL (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQVPL

SEQ ID NO: 330443 - protein, 23 aa, Artificial Sequence
  Description of Artificial Sequence: Synthetic peptide
  Seed: LAVVSTQLIMPGQEAGLGQVPLI (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQVPLI

SEQ ID NO: 330444 - protein, 23 aa, Artificial Sequence
  Description of Artificial Sequence: Synthetic peptide
  Seed: LAVVSTQLIMPGQEAGLGQVPLI (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQVPLI

SEQ ID NO: 330445 - protein, 23 aa, Artificial Sequence
  Description of Artificial Sequence: Synthetic peptide
  Seed: LAVVSTQLIMPGQEAGLGQVPLI (PMEL_HUMAN)
  Core: IMPGQEAGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTQLXMPXQXAGXGQVPLI

SEQ ID NO: 330446 - protein, 24 aa, Artificial Sequence
  Description of Artificial Sequence: Synthetic peptide
  Seed: LAVVSTQLIMPGQEAGLGQVPLIV (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQVPLIV

SEQ ID NO: 330447 - protein, 24 aa, Artificial Sequence
  Description of Artificial Sequence: Synthetic peptide
  Seed: LAVVSTQLIMPGQEAGLGQVPLIV (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQVPLIV

SEQ ID NO: 330448 - protein, 24 aa, Artificial Sequence
  Description of Artificial Sequence: Synthetic peptide
  Seed: LAVVSTQLIMPGQEAGLGQVPLIV (PMEL_HUMAN)
  Core: IMPGQEAGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTQLXMPXQXAGXGQVPLIV

SEQ ID NO: 330449 - protein, 25 aa, Artificial Sequence
  Description of Artificial Sequence: Synthetic peptide
  Seed: LAVVSTQLIMPGQEAGLGQVPLIVG (PMEL_HUMAN)
  Core: VSTQLIMPG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LAVXSTXLXMPXQEAGLGQVPLIVG

SEQ ID NO: 330450 - protein, 25 aa, Artificial Sequence
  Description of Artificial Sequence: Synthetic peptide
  Seed: LAVVSTQLIMPGQEAGLGQVPLIVG (PMEL_HUMAN)
  Core: QLIMPGQEA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTXLIXPXQEXGLGQVPLIVG

SEQ ID NO: 330451 - protein, 25 aa, Artificial Sequence
  Description of Artificial Sequence: Synthetic peptide
  Seed: LAVVSTQLIMPGQEAGLGQVPLIVG (PMEL_HUMAN)
  Core: IMPGQEAGL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LAVVSTQLXMPXQXAGXGQVPLIVG

SEQ ID NO: 330452 - protein, 15 aa, Artificial Sequence
  Description of Artificial Sequence: Synthetic peptide
  Seed: LCQPVLPSPACQLVL (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVL

SEQ ID NO: 330453 - protein, 16 aa, Artificial Sequence
  Description of Artificial Sequence: Synthetic peptide
  Seed: LCQPVLPSPACQLVLH (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLH

SEQ ID NO: 330454 - protein, 17 aa, Artificial Sequence
  Description of Artificial Sequence: Synthetic peptide
  Seed: LCQPVLPSPACQLVLHQ (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQ

SEQ ID NO: 330455 - protein, 19 aa, Artificial Sequence
  Description of Artificial Sequence: Synthetic peptide
  Seed: LCQPVLPSPACQLVLHQIL (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQIL

SEQ ID NO: 330456 - protein, 20 aa, Artificial Sequence
  Description of Artificial Sequence: Synthetic peptide
  Seed: LCQPVLPSPACQLVLHQILK (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQILK

SEQ ID NO: 330457 - protein, 20 aa, Artificial Sequence
  Description of Artificial Sequence: Synthetic peptide
  Seed: LCQPVLPSPACQLVLHQILK (PMEL_HUMAN)
  Core: PACQLVLHQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSXACXLXLHXILK

SEQ ID NO: 330458 - protein, 20 aa, Artificial Sequence
  Description of Artificial Sequence: Synthetic peptide
  Seed: LCQPVLPSPACQLVLHQILK (PMEL_HUMAN)
  Core: CQLVLHQIL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPAXQLXLXQIXK

SEQ ID NO: 330459 - protein, 21 aa, Artificial Sequence
  Description of Artificial Sequence: Synthetic peptide
  Seed: LCQPVLPSPACQLVLHQILKG (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQILKG

SEQ ID NO: 330460 - protein, 21 aa, Artificial Sequence
  Description of Artificial Sequence: Synthetic peptide
  Seed: LCQPVLPSPACQLVLHQILKG (PMEL_HUMAN)
  Core: PACQLVLHQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSXACXLXLHXILKG

SEQ ID NO: 330461 - protein, 21 aa, Artificial Sequence
  Description of Artificial Sequence: Synthetic peptide
  Seed: LCQPVLPSPACQLVLHQILKG (PMEL_HUMAN)
  Core: ACQLVLHQI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPXCQXVXHQXLKG

SEQ ID NO: 330462 - protein, 21 aa, Artificial Sequence
  Description of Artificial Sequence: Synthetic peptide
  Seed: LCQPVLPSPACQLVLHQILKG (PMEL_HUMAN)
  Core: CQLVLHQIL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPAXQLXLXQIXKG

SEQ ID NO: 330463 - protein, 21 aa, Artificial Sequence
  Description of Artificial Sequence: Synthetic peptide
  Seed: LCQPVLPSPACQLVLHQILKG (PMEL_HUMAN)
  Core: LVLHQILKG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQXVLXQXLKX

SEQ ID NO: 330464 - protein, 22 aa, Artificial Sequence
  Description of Artificial Sequence: Synthetic peptide
  Seed: LCQPVLPSPACQLVLHQILKGG (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQILKGG

SEQ ID NO: 330465 - protein, 22 aa, Artificial Sequence
  Description of Artificial Sequence: Synthetic peptide
  Seed: LCQPVLPSPACQLVLHQILKGG (PMEL_HUMAN)
  Core: CQLVLHQIL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPAXQLXLXQIXKGG

SEQ ID NO: 330466 - protein, 22 aa, Artificial Sequence
  Description of Artificial Sequence: Synthetic peptide
  Seed: LCQPVLPSPACQLVLHQILKGG (PMEL_HUMAN)
  Core: LVLHQILKG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQXVLXQXLKXG

SEQ ID NO: 330467 - protein, 23 aa, Artificial Sequence
  Description of Artificial Sequence: Synthetic peptide
  Seed: LCQPVLPSPACQLVLHQILKGGS (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQILKGGS

SEQ ID NO: 330468 - protein, 23 aa, Artificial Sequence
  Description of Artificial Sequence: Synthetic peptide
  Seed: LCQPVLPSPACQLVLHQILKGGS (PMEL_HUMAN)
  Core: CQLVLHQIL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPAXQLXLXQIXKGGS

SEQ ID NO: 330469 - protein, 23 aa, Artificial Sequence
  Description of Artificial Sequence: Synthetic peptide
  Seed: LCQPVLPSPACQLVLHQILKGGS (PMEL_HUMAN)
  Core: LVLHQILKG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQXVLXQXLKXGS

SEQ ID NO: 330470 - protein, 24 aa, Artificial Sequence
  Description of Artificial Sequence: Synthetic peptide
  Seed: LCQPVLPSPACQLVLHQILKGGSG (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQILKGGSG

SEQ ID NO: 330471 - protein, 24 aa, Artificial Sequence
  Description of Artificial Sequence: Synthetic peptide
  Seed: LCQPVLPSPACQLVLHQILKGGSG (PMEL_HUMAN)
  Core: CQLVLHQIL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPAXQLXLXQIXKGGSG

SEQ ID NO: 330472 - protein, 24 aa, Artificial Sequence
  Description of Artificial Sequence: Synthetic peptide
  Seed: LCQPVLPSPACQLVLHQILKGGSG (PMEL_HUMAN)
  Core: LVLHQILKG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQXVLXQXLKXGSG

SEQ ID NO: 330473 - protein, 24 aa, Artificial Sequence
  Description of Artificial Sequence: Synthetic peptide
  Seed: LCQPVLPSPACQLVLHQILKGGSG (PMEL_HUMAN)
  Core: LHQILKGGS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQLVXHQXLXGGXG

SEQ ID NO: 330474 - protein, 25 aa, Artificial Sequence
  Description of Artificial Sequence: Synthetic peptide
  Seed: LCQPVLPSPACQLVLHQILKGGSGT (PMEL_HUMAN)
  Core: VLPSPACQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LCQPXLPXPXCQXVLHQILKGGSGT

SEQ ID NO: 330475 - protein, 25 aa, Artificial Sequence
  Description of Artificial Sequence: Synthetic peptide
  Seed: LCQPVLPSPACQLVLHQILKGGSGT (PMEL_HUMAN)
  Core: CQLVLHQIL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPAXQLXLXQIXKGGSGT

SEQ ID NO: 330476 - protein, 25 aa, Artificial Sequence
  Description of Artificial Sequence: Synthetic peptide
  Seed: LCQPVLPSPACQLVLHQILKGGSGT (PMEL_HUMAN)
  Core: LVLHQILKG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQXVLXQXLKXGSGT

SEQ ID NO: 330477 - protein, 25 aa, Artificial Sequence
  Description of Artificial Sequence: Synthetic peptide
  Seed: LCQPVLPSPACQLVLHQILKGGSGT (PMEL_HUMAN)
  Core: LHQILKGGS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LCQPVLPSPACQLVXHQXLXGGXGT

SEQ ID NO: 330478 - protein, 13 aa, Artificial Sequence
  Description of Artificial Sequence: Synthetic peptide
  Seed: LDCVLYRYGSFSV (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSX

SEQ ID NO: 330479 - protein, 14 aa, Artificial Sequence
  Description of Artificial Sequence: Synthetic peptide
  Seed: LDCVLYRYGSFSVT (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXT

SEQ ID NO: 330480 - protein, 14 aa, Artificial Sequence
  Description of Artificial Sequence: Synthetic peptide
  Seed: LDCVLYRYGSFSVT (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVX

SEQ ID NO: 330481 - protein, 15 aa, Artificial Sequence
  Description of Artificial Sequence: Synthetic peptide
  Seed: LDCVLYRYGSFSVTL (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTL

SEQ ID NO: 330482 - protein, 15 aa, Artificial Sequence
  Description of Artificial Sequence: Synthetic peptide
  Seed: LDCVLYRYGSFSVTL (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXL

SEQ ID NO: 330483 - protein, 15 aa, Artificial Sequence
  Description of Artificial Sequence: Synthetic peptide
  Seed: LDCVLYRYGSFSVTL (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTX

SEQ ID NO: 330484 - protein, 16 aa, Artificial Sequence
  Description of Artificial Sequence: Synthetic peptide
  Seed: LDCVLYRYGSFSVTLD (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLD

SEQ ID NO: 330485 - protein, 16 aa, Artificial Sequence
  Description of Artificial Sequence: Synthetic peptide
  Seed: LDCVLYRYGSFSVTLD (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLD

SEQ ID NO: 330486 - protein, 16 aa, Artificial Sequence
  Description of Artificial Sequence: Synthetic peptide
  Seed: LDCVLYRYGSFSVTLD (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXD

SEQ ID NO: 330487 - protein, 16 aa, Artificial Sequence
  Description of Artificial Sequence: Synthetic peptide
  Seed: LDCVLYRYGSFSVTLD (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLX

SEQ ID NO: 330488 - protein, 17 aa, Artificial Sequence
  Description of Artificial Sequence: Synthetic peptide
  Seed: LDCVLYRYGSFSVTLDI (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDI

SEQ ID NO: 330489 - protein, 17 aa, Artificial Sequence
  Description of Artificial Sequence: Synthetic peptide
  Seed: LDCVLYRYGSFSVTLDI (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDI

SEQ ID NO: 330490 - protein, 17 aa, Artificial Sequence
  Description of Artificial Sequence: Synthetic peptide
  Seed: LDCVLYRYGSFSVTLDI (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDI

SEQ ID NO: 330491 - protein, 17 aa, Artificial Sequence
  Description of Artificial Sequence: Synthetic peptide
  Seed: LDCVLYRYGSFSVTLDI (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXI

SEQ ID NO: 330492 - protein, 18 aa, Artificial Sequence
  Description of Artificial Sequence: Synthetic peptide
  Seed: LDCVLYRYGSFSVTLDIV (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIV

SEQ ID NO: 330493 - protein, 18 aa, Artificial Sequence
  Description of Artificial Sequence: Synthetic peptide
  Seed: LDCVLYRYGSFSVTLDIV (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIV

SEQ ID NO: 330494 - protein, 18 aa, Artificial Sequence
  Description of Artificial Sequence: Synthetic peptide
  Seed: LDCVLYRYGSFSVTLDIV (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIV

SEQ ID NO: 330495 - protein, 18 aa, Artificial Sequence
  Description of Artificial Sequence: Synthetic peptide
  Seed: LDCVLYRYGSFSVTLDIV (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIV

SEQ ID NO: 330496 - protein, 19 aa, Artificial Sequence
  Description of Artificial Sequence: Synthetic peptide
  Seed: LDCVLYRYGSFSVTLDIVQ (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQ

SEQ ID NO: 330497 - protein, 19 aa, Artificial Sequence
  Description of Artificial Sequence: Synthetic peptide
  Seed: LDCVLYRYGSFSVTLDIVQ (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQ

SEQ ID NO: 330498 - protein, 19 aa, Artificial Sequence
  Description of Artificial Sequence: Synthetic peptide
  Seed: LDCVLYRYGSFSVTLDIVQ (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQ

SEQ ID NO: 330499 - protein, 19 aa, Artificial Sequence
  Description of Artificial Sequence: Synthetic peptide
  Seed: LDCVLYRYGSFSVTLDIVQ (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQ

SEQ ID NO: 330500 - protein, 19 aa, Artificial Sequence
  Description of Artificial Sequence: Synthetic peptide
  Seed: LDCVLYRYGSFSVTLDIVQ (PMEL_HUMAN)
  Core: SFSVTLDIV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGXFSXTXDIXQ

SEQ ID NO: 330501 - protein, 20 aa, Artificial Sequence
  Description of Artificial Sequence: Synthetic peptide
  Seed: LDCVLYRYGSFSVTLDIVQG (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQG

SEQ ID NO: 330502 - protein, 20 aa, Artificial Sequence
  Description of Artificial Sequence: Synthetic peptide
  Seed: LDCVLYRYGSFSVTLDIVQG (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQG

SEQ ID NO: 330503 - protein, 20 aa, Artificial Sequence
  Description of Artificial Sequence: Synthetic peptide
  Seed: LDCVLYRYGSFSVTLDIVQG (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQG

SEQ ID NO: 330504 - protein, 20 aa, Artificial Sequence
  Description of Artificial Sequence: Synthetic peptide
  Seed: LDCVLYRYGSFSVTLDIVQG (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQG

SEQ ID NO: 330505 - protein, 20 aa, Artificial Sequence
  Description of Artificial Sequence: Synthetic peptide
  Seed: LDCVLYRYGSFSVTLDIVQG (PMEL_HUMAN)
  Core: SFSVTLDIV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGXFSXTXDIXQG

SEQ ID NO: 330506 - protein, 20 aa, Artificial Sequence
  Description of Artificial Sequence: Synthetic peptide
  Seed: LDCVLYRYGSFSVTLDIVQG (PMEL_HUMAN)
  Core: FSVTLDIVQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSXSVXLXIVXG

SEQ ID NO: 330507 - protein, 21 aa, Artificial Sequence
  Description of Artificial Sequence: Synthetic peptide
  Seed: LDCVLYRYGSFSVTLDIVQGI (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQGI

SEQ ID NO: 330508 - protein, 21 aa, Artificial Sequence
  Description of Artificial Sequence: Synthetic peptide
  Seed: LDCVLYRYGSFSVTLDIVQGI (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQGI

SEQ ID NO: 330509 - protein, 21 aa, Artificial Sequence
  Description of Artificial Sequence: Synthetic peptide
  Seed: LDCVLYRYGSFSVTLDIVQGI (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQGI

SEQ ID NO: 330510 - protein, 21 aa, Artificial Sequence
  Description of Artificial Sequence: Synthetic peptide
  Seed: LDCVLYRYGSFSVTLDIVQGI (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQGI

SEQ ID NO: 330511 - protein, 21 aa, Artificial Sequence
  Description of Artificial Sequence: Synthetic peptide
  Seed: LDCVLYRYGSFSVTLDIVQGI (PMEL_HUMAN)
  Core: SFSVTLDIV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGXFSXTXDIXQGI

SEQ ID NO: 330512 - protein, 22 aa, Artificial Sequence
  Description of Artificial Sequence: Synthetic peptide
  Seed: LDCVLYRYGSFSVTLDIVQGIE (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQGIE

SEQ ID NO: 330513 - protein, 22 aa, Artificial Sequence
  Description of Artificial Sequence: Synthetic peptide
  Seed: LDCVLYRYGSFSVTLDIVQGIE (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQGIE

SEQ ID NO: 330514 - protein, 22 aa, Artificial Sequence
  Description of Artificial Sequence: Synthetic peptide
  Seed: LDCVLYRYGSFSVTLDIVQGIE (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQGIE

SEQ ID NO: 330515 - protein, 22 aa, Artificial Sequence
  Description of Artificial Sequence: Synthetic peptide
  Seed: LDCVLYRYGSFSVTLDIVQGIE (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQGIE

SEQ ID NO: 330516 - protein, 22 aa, Artificial Sequence
  Description of Artificial Sequence: Synthetic peptide
  Seed: LDCVLYRYGSFSVTLDIVQGIE (PMEL_HUMAN)
  Core: FSVTLDIVQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSXSVXLXIVXGIE

SEQ ID NO: 330517 - protein, 22 aa, Artificial Sequence
  Description of Artificial Sequence: Synthetic peptide
  Seed: LDCVLYRYGSFSVTLDIVQGIE (PMEL_HUMAN)
  Core: VTLDIVQGI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSFSXTLXIXQGXE

SEQ ID NO: 330518 - protein, 23 aa, Artificial Sequence
  Description of Artificial Sequence: Synthetic peptide
  Seed: LDCVLYRYGSFSVTLDIVQGIES (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQGIES

SEQ ID NO: 330519 - protein, 23 aa, Artificial Sequence
  Description of Artificial Sequence: Synthetic peptide
  Seed: LDCVLYRYGSFSVTLDIVQGIES (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQGIES

SEQ ID NO: 330520 - protein, 23 aa, Artificial Sequence
  Description of Artificial Sequence: Synthetic peptide
  Seed: LDCVLYRYGSFSVTLDIVQGIES (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQGIES

SEQ ID NO: 330521 - protein, 23 aa, Artificial Sequence
  Description of Artificial Sequence: Synthetic peptide
  Seed: LDCVLYRYGSFSVTLDIVQGIES (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQGIES

SEQ ID NO: 330522 - protein, 23 aa, Artificial Sequence
  Description of Artificial Sequence: Synthetic peptide
  Seed: LDCVLYRYGSFSVTLDIVQGIES (PMEL_HUMAN)
  Core: FSVTLDIVQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSXSVXLXIVXGIES

SEQ ID NO: 330523 - protein, 23 aa, Artificial Sequence
  Description of Artificial Sequence: Synthetic peptide
  Seed: LDCVLYRYGSFSVTLDIVQGIES (PMEL_HUMAN)
  Core: VTLDIVQGI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSFSXTLXIXQGXES

SEQ ID NO: 330524 - protein, 24 aa, Artificial Sequence
  Description of Artificial Sequence: Synthetic peptide
  Seed: LDCVLYRYGSFSVTLDIVQGIESA (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQGIESA

SEQ ID NO: 330525 - protein, 24 aa, Artificial Sequence
  Description of Artificial Sequence: Synthetic peptide
  Seed: LDCVLYRYGSFSVTLDIVQGIESA (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQGIESA

SEQ ID NO: 330526 - protein, 24 aa, Artificial Sequence
  Description of Artificial Sequence: Synthetic peptide
  Seed: LDCVLYRYGSFSVTLDIVQGIESA (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQGIESA

SEQ ID NO: 330527 - protein, 24 aa, Artificial Sequence
  Description of Artificial Sequence: Synthetic peptide
  Seed: LDCVLYRYGSFSVTLDIVQGIESA (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQGIESA

SEQ ID NO: 330528 - protein, 24 aa, Artificial Sequence
  Description of Artificial Sequence: Synthetic peptide
  Seed: LDCVLYRYGSFSVTLDIVQGIESA (PMEL_HUMAN)
  Core: FSVTLDIVQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSXSVXLXIVXGIESA

SEQ ID NO: 330529 - protein, 24 aa, Artificial Sequence
  Description of Artificial Sequence: Synthetic peptide
  Seed: LDCVLYRYGSFSVTLDIVQGIESA (PMEL_HUMAN)
  Core: VTLDIVQGI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSFSXTLXIXQGXESA

SEQ ID NO: 330530 - protein, 25 aa, Artificial Sequence
  Description of Artificial Sequence: Synthetic peptide
  Seed: LDCVLYRYGSFSVTLDIVQGIESAE (PMEL_HUMAN)
  Core: LYRYGSFSV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
LDCVXYRXGXFSXTLDIVQGIESAE

SEQ ID NO: 330531 - protein, 25 aa, Artificial Sequence
  Description of Artificial Sequence: Synthetic peptide
  Seed: LDCVLYRYGSFSVTLDIVQGIESAE (PMEL_HUMAN)
  Core: YRYGSFSVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLXRYXSXSVXLDIVQGIESAE

SEQ ID NO: 330532 - protein, 25 aa, Artificial Sequence
  Description of Artificial Sequence: Synthetic peptide
  Seed: LDCVLYRYGSFSVTLDIVQGIESAE (PMEL_HUMAN)
  Core: RYGSFSVTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYXYGXFXVTXDIVQGIESAE

SEQ ID NO: 330533 - protein, 25 aa, Artificial Sequence
  Description of Artificial Sequence: Synthetic peptide
  Seed: LDCVLYRYGSFSVTLDIVQGIESAE (PMEL_HUMAN)
  Core: YGSFSVTLD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRXGSXSXTLXIVQGIESAE

SEQ ID NO: 330534 - protein, 25 aa, Artificial Sequence
  Description of Artificial Sequence: Synthetic peptide
  Seed: LDCVLYRYGSFSVTLDIVQGIESAE (PMEL_HUMAN)
  Core: FSVTLDIVQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSXSVXLXIVXGIESAE

SEQ ID NO: 330535 - protein, 25 aa, Artificial Sequence
  Description of Artificial Sequence: Synthetic peptide
  Seed: LDCVLYRYGSFSVTLDIVQGIESAE (PMEL_HUMAN)
  Core: VTLDIVQGI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSFSXTLXIXQGXESAE

SEQ ID NO: 330536 - protein, 25 aa, Artificial Sequence
  Description of Artificial Sequence: Synthetic peptide
  Seed: LDCVLYRYGSFSVTLDIVQGIESAE (PMEL_HUMAN)
  Core: LDIVQGIES
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
LDCVLYRYGSFSVTXDIXQXIEXAE

SEQ ID NO: 330537 - protein, 13 aa, Artificial Sequence
  Description of Artificial Sequence: Synthetic peptide
  Seed: LDCWRGGQVSLKV (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXV

SEQ ID NO: 330538 - protein, 14 aa, Artificial Sequence
  Description of Artificial Sequence: Synthetic peptide
  Seed: LDCWRGGQVSLKVS (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVS

SEQ ID NO: 330539 - protein, 15 aa, Artificial Sequence
  Description of Artificial Sequence: Synthetic peptide
  Seed: LDCWRGGQVSLKVSN (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSN

SEQ ID NO: 330540 - protein, 16 aa, Artificial Sequence
  Description of Artificial Sequence: Synthetic peptide
  Seed: LDCWRGGQVSLKVSND (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSND

SEQ ID NO: 330541 - protein, 17 aa, Artificial Sequence
  Description of Artificial Sequence: Synthetic peptide
  Seed: LDCWRGGQVSLKVSNDG (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDG

SEQ ID NO: 330542 - protein, 18 aa, Artificial Sequence
  Description of Artificial Sequence: Synthetic peptide
  Seed: LDCWRGGQVSLKVSNDGP (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGP

SEQ ID NO: 330543 - protein, 19 aa, Artificial Sequence
  Description of Artificial Sequence: Synthetic peptide
  Seed: LDCWRGGQVSLKVSNDGPT (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPT

SEQ ID NO: 330544 - protein, 20 aa, Artificial Sequence
  Description of Artificial Sequence: Synthetic peptide
  Seed: LDCWRGGQVSLKVSNDGPTL (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPTL

SEQ ID NO: 330545 - protein, 20 aa, Artificial Sequence
  Description of Artificial Sequence: Synthetic peptide
  Seed: LDCWRGGQVSLKVSNDGPTL (PMEL_HUMAN)
  Core: QVSLKVSND
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCWRGGXVSXKXSNXGPTL

SEQ ID NO: 330546 - protein, 21 aa, Artificial Sequence
  Description of Artificial Sequence: Synthetic peptide
  Seed: LDCWRGGQVSLKVSNDGPTLI (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPTLI

SEQ ID NO: 330547 - protein, 22 aa, Artificial Sequence
  Description of Artificial Sequence: Synthetic peptide
  Seed: LDCWRGGQVSLKVSNDGPTLIG (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPTLIG

SEQ ID NO: 330548 - protein, 23 aa, Artificial Sequence
  Description of Artificial Sequence: Synthetic peptide
  Seed: LDCWRGGQVSLKVSNDGPTLIGA (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPTLIGA

SEQ ID NO: 330549 - protein, 23 aa, Artificial Sequence
  Description of Artificial Sequence: Synthetic peptide
  Seed: LDCWRGGQVSLKVSNDGPTLIGA (PMEL_HUMAN)
  Core: VSNDGPTLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCWRGGQVSLKXSNXGXTLXGA

SEQ ID NO: 330550 - protein, 24 aa, Artificial Sequence
  Description of Artificial Sequence: Synthetic peptide
  Seed: LDCWRGGQVSLKVSNDGPTLIGAN (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPTLIGAN

SEQ ID NO: 330551 - protein, 24 aa, Artificial Sequence
  Description of Artificial Sequence: Synthetic peptide
  Seed: LDCWRGGQVSLKVSNDGPTLIGAN (PMEL_HUMAN)
  Core: VSNDGPTLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCWRGGQVSLKXSNXGXTLXGAN

SEQ ID NO: 330552 - protein, 25 aa, Artificial Sequence
  Description of Artificial Sequence: Synthetic peptide
  Seed: LDCWRGGQVSLKVSNDGPTLIGANA (PMEL_HUMAN)
  Core: WRGGQVSLK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDCXRGXQXSLXVSNDGPTLIGANA

SEQ ID NO: 330553 - protein, 25 aa, Artificial Sequence
  Description of Artificial Sequence: Synthetic peptide
  Seed: LDCWRGGQVSLKVSNDGPTLIGANA (PMEL_HUMAN)
  Core: QVSLKVSND
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDCWRGGXVSXKXSNXGPTLIGANA

SEQ ID NO: 330554 - protein, 25 aa, Artificial Sequence
  Description of Artificial Sequence: Synthetic peptide
  Seed: LDCWRGGQVSLKVSNDGPTLIGANA (PMEL_HUMAN)
  Core: LKVSNDGPT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
LDCWRGGQVSXKVXNXGPXLIGANA

SEQ ID NO: 330555 - protein, 25 aa, Artificial Sequence
  Description of Artificial Sequence: Synthetic peptide
  Seed: LDCWRGGQVSLKVSNDGPTLIGANA (PMEL_HUMAN)
  Core: VSNDGPTLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDCWRGGQVSLKXSNXGXTLXGANA

SEQ ID NO: 330556 - protein, 15 aa, Artificial Sequence
  Description of Artificial Sequence: Synthetic peptide
  Seed: LDGGNKHFLRNQPLT (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXT

SEQ ID NO: 330557 - protein, 16 aa, Artificial Sequence
  Description of Artificial Sequence: Synthetic peptide
  Seed: LDGGNKHFLRNQPLTF (PMEL_HUMAN)
  Core: GGNKHFLRN
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
LDXGNXHXLRXQPLTF

SEQ ID NO: 330558 - protein, 16 aa, Artificial Sequence
  Description of Artificial Sequence: Synthetic peptide
  Seed: LDGGNKHFLRNQPLTF (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTF

SEQ ID NO: 330559 - protein, 16 aa, Artificial Sequence
  Description of Artificial Sequence: Synthetic peptide
  Seed: LDGGNKHFLRNQPLTF (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTX

SEQ ID NO: 330560 - protein, 17 aa, Artificial Sequence
  Description of Artificial Sequence: Synthetic peptide
  Seed: LDGGNKHFLRNQPLTFA (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFA

SEQ ID NO: 330561 - protein, 17 aa, Artificial Sequence
  Description of Artificial Sequence: Synthetic peptide
  Seed: LDGGNKHFLRNQPLTFA (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXA

SEQ ID NO: 330562 - protein, 18 aa, Artificial Sequence
  Description of Artificial Sequence: Synthetic peptide
  Seed: LDGGNKHFLRNQPLTFAL (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFAL

SEQ ID NO: 330563 - protein, 18 aa, Artificial Sequence
  Description of Artificial Sequence: Synthetic peptide
  Seed: LDGGNKHFLRNQPLTFAL (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXAL

SEQ ID NO: 330564 - protein, 18 aa, Artificial Sequence
  Description of Artificial Sequence: Synthetic peptide
  Seed: LDGGNKHFLRNQPLTFAL (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXL

SEQ ID NO: 330565 - protein, 19 aa, Artificial Sequence
  Description of Artificial Sequence: Synthetic peptide
  Seed: LDGGNKHFLRNQPLTFALQ (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQ

SEQ ID NO: 330566 - protein, 19 aa, Artificial Sequence
  Description of Artificial Sequence: Synthetic peptide
  Seed: LDGGNKHFLRNQPLTFALQ (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQ

SEQ ID NO: 330567 - protein, 19 aa, Artificial Sequence
  Description of Artificial Sequence: Synthetic peptide
  Seed: LDGGNKHFLRNQPLTFALQ (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQ

SEQ ID NO: 330568 - protein, 20 aa, Artificial Sequence
  Description of Artificial Sequence: Synthetic peptide
  Seed: LDGGNKHFLRNQPLTFALQL (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQL

SEQ ID NO: 330569 - protein, 20 aa, Artificial Sequence
  Description of Artificial Sequence: Synthetic peptide
  Seed: LDGGNKHFLRNQPLTFALQL (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQL

SEQ ID NO: 330570 - protein, 20 aa, Artificial Sequence
  Description of Artificial Sequence: Synthetic peptide
  Seed: LDGGNKHFLRNQPLTFALQL (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQL

SEQ ID NO: 330571 - protein, 21 aa, Artificial Sequence
  Description of Artificial Sequence: Synthetic peptide
  Seed: LDGGNKHFLRNQPLTFALQLH (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQLH

SEQ ID NO: 330572 - protein, 21 aa, Artificial Sequence
  Description of Artificial Sequence: Synthetic peptide
  Seed: LDGGNKHFLRNQPLTFALQLH (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQLH

SEQ ID NO: 330573 - protein, 21 aa, Artificial Sequence
  Description of Artificial Sequence: Synthetic peptide
  Seed: LDGGNKHFLRNQPLTFALQLH (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQLH

SEQ ID NO: 330574 - protein, 21 aa, Artificial Sequence
  Description of Artificial Sequence: Synthetic peptide
  Seed: LDGGNKHFLRNQPLTFALQLH (PMEL_HUMAN)
  Core: RNQPLTFAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLXNQXLXFAXQLH

SEQ ID NO: 330575 - protein, 22 aa, Artificial Sequence
  Description of Artificial Sequence: Synthetic peptide
  Seed: LDGGNKHFLRNQPLTFALQLHD (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQLHD

SEQ ID NO: 330576 - protein, 22 aa, Artificial Sequence
  Description of Artificial Sequence: Synthetic peptide
  Seed: LDGGNKHFLRNQPLTFALQLHD (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQLHD

SEQ ID NO: 330577 - protein, 22 aa, Artificial Sequence
  Description of Artificial Sequence: Synthetic peptide
  Seed: LDGGNKHFLRNQPLTFALQLHD (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQLHD

SEQ ID NO: 330578 - protein, 22 aa, Artificial Sequence
  Description of Artificial Sequence: Synthetic peptide
  Seed: LDGGNKHFLRNQPLTFALQLHD (PMEL_HUMAN)
  Core: RNQPLTFAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLXNQXLXFAXQLHD

SEQ ID NO: 330579 - protein, 22 aa, Artificial Sequence
  Description of Artificial Sequence: Synthetic peptide
  Seed: LDGGNKHFLRNQPLTFALQLHD (PMEL_HUMAN)
  Core: PLTFALQLH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQXLTXAXQLXD

SEQ ID NO: 330580 - protein, 23 aa, Artificial Sequence
  Description of Artificial Sequence: Synthetic peptide
  Seed: LDGGNKHFLRNQPLTFALQLHDP (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQLHDP

SEQ ID NO: 330581 - protein, 23 aa, Artificial Sequence
  Description of Artificial Sequence: Synthetic peptide
  Seed: LDGGNKHFLRNQPLTFALQLHDP (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQLHDP

SEQ ID NO: 330582 - protein, 23 aa, Artificial Sequence
  Description of Artificial Sequence: Synthetic peptide
  Seed: LDGGNKHFLRNQPLTFALQLHDP (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQLHDP

SEQ ID NO: 330583 - protein, 23 aa, Artificial Sequence
  Description of Artificial Sequence: Synthetic peptide
  Seed: LDGGNKHFLRNQPLTFALQLHDP (PMEL_HUMAN)
  Core: RNQPLTFAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLXNQXLXFAXQLHDP

SEQ ID NO: 330584 - protein, 23 aa, Artificial Sequence
  Description of Artificial Sequence: Synthetic peptide
  Seed: LDGGNKHFLRNQPLTFALQLHDP (PMEL_HUMAN)
  Core: PLTFALQLH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQXLTXAXQLXDP

SEQ ID NO: 330585 - protein, 23 aa, Artificial Sequence
  Description of Artificial Sequence: Synthetic peptide
  Seed: LDGGNKHFLRNQPLTFALQLHDP (PMEL_HUMAN)
  Core: LTFALQLHD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQPXTFXLXLHXP

SEQ ID NO: 330586 - protein, 24 aa, Artificial Sequence
  Description of Artificial Sequence: Synthetic peptide
  Seed: LDGGNKHFLRNQPLTFALQLHDPS (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQLHDPS

SEQ ID NO: 330587 - protein, 24 aa, Artificial Sequence
  Description of Artificial Sequence: Synthetic peptide
  Seed: LDGGNKHFLRNQPLTFALQLHDPS (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQLHDPS

SEQ ID NO: 330588 - protein, 24 aa, Artificial Sequence
  Description of Artificial Sequence: Synthetic peptide
  Seed: LDGGNKHFLRNQPLTFALQLHDPS (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQLHDPS

SEQ ID NO: 330589 - protein, 24 aa, Artificial Sequence
  Description of Artificial Sequence: Synthetic peptide
  Seed: LDGGNKHFLRNQPLTFALQLHDPS (PMEL_HUMAN)
  Core: RNQPLTFAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLXNQXLXFAXQLHDPS

SEQ ID NO: 330590 - protein, 24 aa, Artificial Sequence
  Description of Artificial Sequence: Synthetic peptide
  Seed: LDGGNKHFLRNQPLTFALQLHDPS (PMEL_HUMAN)
  Core: PLTFALQLH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQXLTXAXQLXDPS

SEQ ID NO: 330591 - protein, 24 aa, Artificial Sequence
  Description of Artificial Sequence: Synthetic peptide
  Seed: LDGGNKHFLRNQPLTFALQLHDPS (PMEL_HUMAN)
  Core: LTFALQLHD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQPXTFXLXLHXPS

SEQ ID NO: 330592 - protein, 25 aa, Artificial Sequence
  Description of Artificial Sequence: Synthetic peptide
  Seed: LDGGNKHFLRNQPLTFALQLHDPSG (PMEL_HUMAN)
  Core: KHFLRNQPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNXHFXRXQPXTFALQLHDPSG

SEQ ID NO: 330593 - protein, 25 aa, Artificial Sequence
  Description of Artificial Sequence: Synthetic peptide
  Seed: LDGGNKHFLRNQPLTFALQLHDPSG (PMEL_HUMAN)
  Core: FLRNQPLTF
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHXLRXQXLTXALQLHDPSG

SEQ ID NO: 330594 - protein, 25 aa, Artificial Sequence
  Description of Artificial Sequence: Synthetic peptide
  Seed: LDGGNKHFLRNQPLTFALQLHDPSG (PMEL_HUMAN)
  Core: LRNQPLTFA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFXRNXPXTFXLQLHDPSG

SEQ ID NO: 330595 - protein, 25 aa, Artificial Sequence
  Description of Artificial Sequence: Synthetic peptide
  Seed: LDGGNKHFLRNQPLTFALQLHDPSG (PMEL_HUMAN)
  Core: RNQPLTFAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLXNQXLXFAXQLHDPSG

SEQ ID NO: 330596 - protein, 25 aa, Artificial Sequence
  Description of Artificial Sequence: Synthetic peptide
  Seed: LDGGNKHFLRNQPLTFALQLHDPSG (PMEL_HUMAN)
  Core: PLTFALQLH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQXLTXAXQLXDPSG

SEQ ID NO: 330597 - protein, 25 aa, Artificial Sequence
  Description of Artificial Sequence: Synthetic peptide
  Seed: LDGGNKHFLRNQPLTFALQLHDPSG (PMEL_HUMAN)
  Core: LTFALQLHD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
LDGGNKHFLRNQPXTFXLXLHXPSG

SEQ ID NO: 330598 - protein, 14 aa, Artificial Sequence
  Description of Artificial Sequence: Synthetic peptide
  Seed: LDGTATLRLVKRQV (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQV

SEQ ID NO: 330599 - protein, 14 aa, Artificial Sequence
  Description of Artificial Sequence: Synthetic peptide
  Seed: LDGTATLRLVKRQV (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQX

SEQ ID NO: 330600 - protein, 15 aa, Artificial Sequence
  Description of Artificial Sequence: Synthetic peptide
  Seed: LDGTATLRLVKRQVP (PMEL_HUMAN)
  Core: DGTATLRLV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGTXTXRLXKRQVP

SEQ ID NO: 330601 - protein, 15 aa, Artificial Sequence
  Description of Artificial Sequence: Synthetic peptide
  Seed: LDGTATLRLVKRQVP (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVP

SEQ ID NO: 330602 - protein, 15 aa, Artificial Sequence
  Description of Artificial Sequence: Synthetic peptide
  Seed: LDGTATLRLVKRQVP (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXP

SEQ ID NO: 330603 - protein, 15 aa, Artificial Sequence
  Description of Artificial Sequence: Synthetic peptide
  Seed: LDGTATLRLVKRQVP (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVX

SEQ ID NO: 330604 - protein, 16 aa, Artificial Sequence
  Description of Artificial Sequence: Synthetic peptide
  Seed: LDGTATLRLVKRQVPL (PMEL_HUMAN)
  Core: DGTATLRLV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGTXTXRLXKRQVPL

SEQ ID NO: 330605 - protein, 16 aa, Artificial Sequence
  Description of Artificial Sequence: Synthetic peptide
  Seed: LDGTATLRLVKRQVPL (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPL

SEQ ID NO: 330606 - protein, 16 aa, Artificial Sequence
  Description of Artificial Sequence: Synthetic peptide
  Seed: LDGTATLRLVKRQVPL (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXPL

SEQ ID NO: 330607 - protein, 16 aa, Artificial Sequence
  Description of Artificial Sequence: Synthetic peptide
  Seed: LDGTATLRLVKRQVPL (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXL

SEQ ID NO: 330608 - protein, 17 aa, Artificial Sequence
  Description of Artificial Sequence: Synthetic peptide
  Seed: LDGTATLRLVKRQVPLD (PMEL_HUMAN)
  Core: DGTATLRLV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGTXTXRLXKRQVPLD

SEQ ID NO: 330609 - protein, 17 aa, Artificial Sequence
  Description of Artificial Sequence: Synthetic peptide
  Seed: LDGTATLRLVKRQVPLD (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLD

SEQ ID NO: 330610 - protein, 18 aa, Artificial Sequence
  Description of Artificial Sequence: Synthetic peptide
  Seed: LDGTATLRLVKRQVPLDC (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDC

SEQ ID NO: 330611 - protein, 19 aa, Artificial Sequence
  Description of Artificial Sequence: Synthetic peptide
  Seed: LDGTATLRLVKRQVPLDCV (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCV

SEQ ID NO: 330612 - protein, 19 aa, Artificial Sequence
  Description of Artificial Sequence: Synthetic peptide
  Seed: LDGTATLRLVKRQVPLDCV (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCV

SEQ ID NO: 330613 - protein, 19 aa, Artificial Sequence
  Description of Artificial Sequence: Synthetic peptide
  Seed: LDGTATLRLVKRQVPLDCV (PMEL_HUMAN)
  Core: RLVKRQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLXLVXRXVPXDCV

SEQ ID NO: 330614 - protein, 19 aa, Artificial Sequence
  Description of Artificial Sequence: Synthetic peptide
  Seed: LDGTATLRLVKRQVPLDCV (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCV

SEQ ID NO: 330615 - protein, 19 aa, Artificial Sequence
  Description of Artificial Sequence: Synthetic peptide
  Seed: LDGTATLRLVKRQVPLDCV (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXV

SEQ ID NO: 330616 - protein, 20 aa, Artificial Sequence
  Description of Artificial Sequence: Synthetic peptide
  Seed: LDGTATLRLVKRQVPLDCVL (PMEL_HUMAN)
  Core: DGTATLRLV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
LXGTXTXRLXKRQVPLDCVL

SEQ ID NO: 330617 - protein, 20 aa, Artificial Sequence
  Description of Artificial Sequence: Synthetic peptide
  Seed: LDGTATLRLVKRQVPLDCVL (PMEL_HUMAN)
  Core: TATLRLVKR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
LDGXATXRXVKXQVPLDCVL

SEQ ID NO: 330618 - protein, 20 aa, Artificial Sequence
  Description of Artificial Sequence: Synthetic peptide
  Seed: LDGTATLRLVKRQVPLDCVL (PMEL_HUMAN)
  Core: TLRLVKRQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
LDGTAXLRXVXRQXPLDCVL

SEQ ID NO: 330619 - protein, 20 aa, Artificial Sequence
  Description of Artificial Sequence: Synthetic peptide
  Seed: LDGTATLRLVKRQVPLDCVL (PMEL_HUMAN)
  Core: LRLVKRQVP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATXRLXKXQVXLDCVL

SEQ ID NO: 330620 - protein, 20 aa, Artificial Sequence
  Description of Artificial Sequence: Synthetic peptide
  Seed: LDGTATLRLVKRQVPLDCVL (PMEL_HUMAN)
  Core: RLVKRQVPL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLXLVXRXVPXDCVL

SEQ ID NO: 330621 - protein, 20 aa, Artificial Sequence
  Description of Artificial Sequence: Synthetic peptide
  Seed: LDGTATLRLVKRQVPLDCVL (PMEL_HUMAN)
  Core: LVKRQVPLD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRXVKXQXPLXCVL

SEQ ID NO: 330622 - protein, 20 aa, Artificial Sequence
  Description of Artificial Sequence: Synthetic peptide
  Seed: LDGTATLRLVKRQVPLDCVL (PMEL_HUMAN)
  Core: VKRQVPLDC
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
LDGTATLRLXKRXVXLDXVL
